United States Patent 11,098,302 (IDENTIFICATION OF POLYNUCLEOTIDES ASSOCIATED WITH A SAMPLE) - sequence listing, part 18

SEQ ID NO: 58720 - DNA, 641 bp, Homo sapiens
  misc_feature: GYAE6OF01CVJ7G.8.42.D09.1.454.CMB.1.raw
  modified_base (237)..(237): a, c, t, g, unknown or other
  misc_feature (237)..(237): n is a, c, g, or t
  modified_base (453)..(453): a, c, t, g, unknown or other
  misc_feature (453)..(453): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacagtcagtcaccatctcctgcactggacgccagcagtnaattacaactatactctcctcgtaaccaacaacaccgaggacaaacgccccaaactcatgttattttggagttacaatacggccgtcctcggtacggtcctgactcgtcttctacgcgtctacgtaagtcgtcggaccaaccgaccgtcctcctcgaccgttctcggtcggtcctcgagtacgtggacggtataggaggtcttagtatttactcgngacacgtctactatacgtcgagtcaacgacgtaacggtaggggttcgtaccggggtacgggaacgggtaccgtaaggttaccgtacccggttaccgtaggtaccgtaccggacccgtaacggtcctccccggtacccccgttcggttacccgttacgttcccgttcccgtcccccgtcccgttacccg

SEQ ID NO: 58721 - DNA, 742 bp, Homo sapiens
  misc_feature: GYAE6OF01C9FNK.8.42.D09.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
tcagctcgcgtgtccacgaccggtgctcgatttagacacatacgcaggggaaagggggggggtctcaggaggcagcgctctcaggacgtcaccacatggcctgggctctgctcctcctcaccctcctcactcgagggcacgacgggtcctcgggccaggtctcgccctgacctcacgtccctcccgtccggcggtccgggtctaccgtggactagtcacgtcacctntcctctgctacgtggacncngacagtcgtacttaacaactntactctcgtacggtaaccaacaaccaccaacggaccaaaccgacccaaactcagtcgttagttttcggacgttacaagtacggccgtaccgtcggtacgggtcctacgtcgtcgtccgttacgtaccgtacggtcctacgtaaccggttcgtacggaactaaccgtacccggtccctacccggttcgtacccgttcgtcggtcggtacctcgtacgcgttacggaggtacgtcggtacggtacttaggttaactttacgtcgttacgacgtacgtactactaacgttacgtacgcggtacgaagtaccggtaacggttaggggttaccgtacggggaccgggtaaccgggtacgttaacggttccgggtacccgtaccgtaacggtaccgtaaccggtacccgtaacggtcccggtcccgtaccccgtcggtacccttaccgttcctttcccggtaccccgtcccggtacccgg

SEQ ID NO: 58722 - DNA, 934 bp, Homo sapiens
  misc_feature: GYAE6OF01A4XHR.8.42.D09.1.454.CMB.1.raw
tcagctcgcgtgtccacgaccggtgctcgatttagacacatacgcagggaaaggggggggagaggagcccagcactgggattccgaggtgtgtccattcggtgatcagcactgaacacagaggactcaccatggagttctggcgtgggcttgggttttccttgttgctaatttacaaaggtgtccagtgtgaggtgcagcgtggtaggagaagtgggaggggtcttgacgtccgacggggtcccggggggtcctggacgtaccgttccgtccgttggtcgcgtacgtccgtcgtcggtcctttccacccgtattacgaagtacggaactacctacgtagtggacgtccgtccgggccccgcgtacggccgtccggaaggggtacgggtcgtagggacggttcgggtaccgtacgttaggttttacgttacgtaccggtcggttacggtaggggtacggacctaaccgaaccgtaccgtaacgacgtacggtaaccggtaccggtaaggtacgggacctaaggttaccttacccggacccggttaccccgaggtaaaccggtaaacgtaacccgtttaaaaaccgttacccggaaaaaccggtaccgtttaaggggttttccgggtaaaacggtttttaaactttaccccggtttaaagaaaacttttaaccgggaaaccggtaaacccttaaccgggttaacgaaacccggggtaaccccggggaaagtaaccccggttaccggggaaacccctttaaagttttaaacgggtacccctttggggaaaacccccggtggtaaacggtaaccgttaacccgggtttacccggggaaacggttttaaacccccggggtcgggttaaaccccccggggacccggggggtttaacccgggggaaaccccgggttaaaccccggggggtttaacccccgg

SEQ ID NO: 58723 - DNA, 712 bp, Homo sapiens
  misc_feature: GYAE6OF01CFK4M.8.42.D09.1.454.CMB.1.raw
  modified_base (132)..(132): a, c, t, g, unknown or other
  misc_feature (132)..(132): n is a, c, g, or t
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactnagggcacgagggtcctgggcccagtctcgccctgactcagccctccctccgcgtccgggtctccgtggacagtcacgtcaccatcctctgcagtggacgccagcagtgtaacttaacaacttntacgtctccgtaggtaaccaaacaaccacccaggacaaacgaccccaaacncactgtatttttgagtacaagtagccgcctacgagggtccctgactcgcttctcagacctcgacgtctacggacaaccgtccggaccttaccgcgtaccgttccgtcggtcggtcctaccgtagacgttggaacggtgtaggacgtcgttagtaactttagttaccgtgtcctacgtctacgtattacgtactacggacaacgtaacgaacggttacggggttacgtacggggacgggtaacggaaccgttaacgggttacccggtaccggttaccccggtaaaggttccccgaaaccgggtacccgggtaaccggtcccggttaccccggtcccccggttacggttacccgttaaccccgttccgtttaaccccgggttacccccctccccggtttaacccccgg

SEQ ID NO: 58724 - DNA, 715 bp, Homo sapiens
  misc_feature: GYAE6OF01CKE3E.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcacgtggacgccagcagtgtacttaacaactatactctcctacggtaaccaacaacaccaggaccaaaaccgccccaaatcaatgtattttggagtacaatacggccgtcccgtcggacgggtccctagtactcgtcttactcgacggcctcaacgtcgtacggaccaaccgaccggccctccgtcgtacccgtctcgtccggcctacgacgtacgtaggaggataggtacggtctaggtatttaacgtacgtgacgtacgtctactaagttacttaccgaaggtactagaaccttaaacggtacggggttacgttaccggggaccgggtaagggtacccgtaaacgggttccggtaacccggtttacccggtaagggttaccccggaaccgggtacccgaaaccgggtcccgtaccccgggttaccccccgtttccgggtaaccccttacccgttcccgttacccccggtttccccccgtaacccctttacccccggg

SEQ ID NO: 58725 - DNA, 874 bp, Homo sapiens
  misc_feature: GYAE6OF01EDS9R.8.42.D09.1.454.CMB.1.raw
  modified_base (807)..(807): a, c, t, g, unknown or other
  misc_feature (807)..(807): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacgagggtcctggcccagtctcgccctgactcacgccctccctccgcgtccgggtcctcgtgactcgtcacgtaccactctcctcgtcgacctacggtggaccgacgacgacgtacggtacttaacttaaaccttaacgttactaccttcccgttaaccggttaaccgaaaacccaaaaccgaaccccgaacccggaaccggaaaaccctaaaaccccgaaaccccttaataacgttagttacggtttttacgtttacggaacgtaactaaacggtaccggcccggttaccggtacggggtaccggttcgtaacgtccgtccttaccttccgacgaccgtccgttaacgtacgttcgaccgaacgtaacccgtccccgtccgttaccgtaccgttacccggtcgtaccggggtaccgtaccctaacgggtagtaccggtaaggggtaaccgtgggtacggaccggtttgtaactttaacgttttacggccgtcgtacgttccgtaaccttagttacgttttaccgacgggactaccgaagtaaccgggttaacgggtacggggtttaccggtaaccgggggaacgggtacccttaaacggtccgggtttaaccggtaccccggttaaggtccggtaaacccggacccgttaacgggccggtttcccccncccgggttacccgttacggttaccctcccgggttcccgttacccccggttccccgtccgtaacccgg

SEQ ID NO: 58726 - DNA, 713 bp, Homo sapiens
  misc_feature: GYAE6OF01D2NI7.8.42.D09.1.454.CMB.1.raw
  modified_base (147)..(147): a, c, t, g, unknown or other
  misc_feature (147)..(147): n is a, c, g, or t
  modified_base (179)..(179): a, c, t, g, unknown or other
  misc_feature (179)..(179): n is a, c, g, or t
  modified_base (423)..(423): a, c, t, g, unknown or other
  misc_feature (423)..(423): n is a, c, g, or t
tcagctcgcgtgtccacgaccggtgctcgatttagacacatacgcaggggaaagggggctgggggtctcagggaggcagcgctctcaggacgtcaccaccatggcctgggctctgcctcctcctcaccctcctcactcagggcacgngggtcctcgggcccagtctcgccctgacctcncgccctccctccgccggttccgggtctccgtggactagtcacgtccacctattcctcctgacctacgtcggacgacccagcgtagtagaacttaacaacttatacttccttacctacggtaaaccaaacgaaccacccgacggaaccaaacccgtaccccctaaactaccgtagttacgtttagtttttacggaacgttacgaaagtacggccgtacctcgggacgggtccagtactcgtctcncgtacgtcgtacgatccaggaccaaccgccggtcctcccgtacgtaccgtcgtccggtcggacctcgaacgcgtcggaacgtgtaggacgtcgtattattaccgtctcgacgactacgtacgtaatttcctggaacggtacaacggacgttaacgggttgggttaccgacgggacggtaaccggttcgaaacgggtttccgaacgttccggtaggaccgtaccggacccgtacggtcccgttccccgggtaccctttagggacccctcggtttacctccccgttaccccg

SEQ ID NO: 58727 - DNA, 862 bp, Homo sapiens
  misc_feature: GYAE6OF01CSE1W.8.42.D09.1.454.CMB.1.raw
  modified_base (221)..(221): a, c, t, g, unknown or other
  misc_feature (221)..(221): n is a, c, g, or t
tcagctcgcgtgtccacgaccggtgctcgatttagacacatacgcagggaaaggggggggagaggagcccagcactgggattccgaggtgtgtccattcggtgatcagcactgaacacaagaggactcaccatggagttctggctgggtcttgggttttccttggttgactaatttacaaaaggtgtaccagtgtgaggtgcagcgtgggtaggagaaggnggggaggggtcttgacgtccggacggggtcccggggggggtcctaggacgtaccttccgtccgtggtcgaccacggcctcggtcggtccttaccgaacctacgtacgtaaggtaacgtaacgaaccttaacgagttacggacggtccgggttaccgggcccccgacccgggtaacggacccggtaaccggggaacggggggaacggggtccggtaggggtagggttcgggttacctacgtttaaggtttacgttaacggtcggtagtaacggtgggtaccggacctaaaccgaccgtacccgtaacgggtactaaccgggtaaccggttccggaaaggggaacggaccgtacgttaaccgttacccgtaccccgttacgtaaccgaagaaccgttaaactaaaccgttaaccgaaacgtaactacggttaagggtaacttaacttaacgttaactaaaacgtacgaaaaccgtaaccggtaaacctaaacgggaccggaaccggtaaccgggtaaacccgtcggtaaaccgttaagttaccgttaacggtgggtaacgaccgtaaggtaacgtacggtacgtaacggtaacgggtcgaacccgggtcccgggtaaacgggcccgtaacccggggtaccccg

SEQ ID NO: 58728 - DNA, 723 bp, Homo sapiens
  misc_feature: GYAE6OF01DE68W.8.42.D09.1.454.CMB.1.raw
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
tcagctcgcgtgtccacgaccggtgctcgatttagacacatacgcagggaaaggggggagaggagcccagcactgggattccgaggtgtgtccattcggtgatcagcactgaacacagaggactcaccagtggtagttctggcgtgggtcttgggttttccttgttgctaattacgaaaggtcgtacctaggtgtgaggtgcagcgtggtaggagaagtggggtagggcttagacgtccgagggcccgggggtcngacgtcgtccgtcgtgtcgcgacgtccgtcgtcgtcttaccagtacgtacgaaggtanacgtactaacgagtcgaccgtccggtacggccccgtacgacggtccgtaccgggaaggggtacggcgtagggtacggtcgttacgttacgtaggttttactttacggacggtaggtaacggtttcgggacgaacccgaactaccgtaacgtaccgggaccgacgtaccggttaccgggtacgggacgtaccgtaacggttacctacccgtaaccgtccgaacgtaacggaacctaacttaaaccgacaagtaactagttggtacttaaccggttactaactaagtaacgaacgtaagaccgtaacgaacgaccgtagtacccgacggtacttaagtacgtacgtgacggtacgagtaatcgagtaccggtacggtacgacggcccgggtacggtagaacccggttacccg

SEQ ID NO: 58729 - DNA, 782 bp, Homo sapiens
  misc_feature: GYAE6OF01C4DHX.8.42.D09.1.454.CMB.1.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacagtcagtcaccatctcctgcacgtggacnccagcagtnattacaactatactctcgtacgtaacaacaaccacccaggaccaaaccgaccccaaactcatgtatttttaggacgtacaagtaacggccgcccgtacggacgggtcctagtactccgtcttctcgacgctacgaagtcacggacaaccgaccgtcctaccgtacggtaccgtcgtccgtcgggtacctccgagtacgtaggacggtagtacggacgtacgttagtatttaaacgttccgtagaccgtacggtaccttacgtaacgtttaacgtacgaacggtacgtaacgaaccggtaaacggttacggggttaccgttaccgggggaaccgggttaaccgggtaacccggttaaacgggtttacccgggtaaccccggttaaccgggttaaccgggtacccgtaaacccggggtaaccccgtaaaccgggttcccggttacccccccgggttaaccccccgggttaccggtttaccccggttaaccctttccccccgggtttacccccgtttcccccccgttacccccggttaaacccccggg

SEQ ID NO: 58730 - DNA, 887 bp, Homo sapiens
  misc_feature: GYAE6OF01DFCSL.8.42.D09.1.454.CMB.1.raw
tcagctcgcgtgtccacgaccggtgctcgatttagacacatacgcagggaaagggggcgtggggtctcaggaggcagcgctctcaggacgtcaccaccgatggcctgggctctgcctcctcctcaccctcctcactcagggcacaggtccgtggcccagtctgccctgactcacgccctcccgtcgccgtccgggtcctcgtggacacgtcagtccaccatctcctgccacgttgggacgtaccgagtccgtagttcgtaacgttaaccaacttacttacttaccgttacccgtacggtaaaccccaaaaccgaaccccgtaacccggaaggtaacccgaaaaaccccgtacccccctaaaattccgttaaacgtttcggttttaaacgttttttacggggaaccggttaaaccgtaaaccgttaaccgggtccccggggtaccccttccggggtaaccggggttcccctaggtaaccgtttccggttcctttaccggacgtaccggtacctacccgtaaggtccggtacgaaccaccgtacccgtcccttccggacgtccgttctcggtcggcctaccgacgacgtaggacgtacgtcggacgtactttgtaactttcgtacgacggcctacggaccttacttaacgttcttacgggaaccggactaaacggtacccgtaaaggggttaccgggttacggttaaccggggaaccgggtaaccgggttaacccgttaaacggggtttccccggtaaaccgggtttaccccggtaaggttaaccccgggaacccggtaaccccgggttaacccgggtcccgttaccccccgggtcccggtttacccggtaaccctttccccgttcccgtttaccccccgttacccccg

SEQ ID NO: 58731 - DNA, 824 bp, Homo sapiens
  misc_feature: GYAE6OF01D8HKO.8.42.D09.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (335)..(335): a, c, t, g, unknown or other
  misc_feature (335)..(335): n is a, c, g, or t
tcagctcgcgtgtccacgaccggtgctcgatttagacacatacgcaggggaaagggggggggtctcaggaggcagcgctctcaggacgtcaccaccatggcctggctctgctcctcctcaccctcctcactcagggcacgacgggtcctcgggcccagtctcgccctgactcacgccctcctccgcgtccggtctcgtgacngtcagtcaccntcctcctgcacgtggacnccagactagtacgtaacttaacaaacgttatacttcctaccgtacggtaacccaaaccaacccgaacccgaacggaaccaaacccgaaccccaactaaaaaacncttacgtttagttttacggacggttaactaaacgtaaccggtacccggtacccttacgggtaccggggtcctacgtacgttccgtaccttaccgtacgacggtaccgtaccgtaacggttccgtaccgaaccgtaaacccgtccggtaccccgttaccgtaccggtcccgtacgttccggtcggtaccctaccgacggtaccggtaggacggtacgtacgggtagtacgttacgttacttacgtaccgtacgactaccgtacgtacttacgtacgttaccggacggacgtaacgtaacgtaacgggttaccgggtacgggtacggggtaacgggtaaccggtaaccggttaacgggttaccggttaccggtccggtaacggttaccggtaaccggtaacccggtacggtacccgttcccggtaccccggttaccggtacccgttaccgtaccccgggtttaccccgttccccgtcccgttaaccccggg

SEQ ID NO: 58732 - DNA, 690 bp, Homo sapiens
  misc_feature: GYAE6OF01EXX38.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgattacaactatatctctgtaccaacaacacccaggcaaacgaccccaaactcatgtattttgagtacaataagccggtccctcgacggggtccctgactcgtcttctcgacggcctaccgaagttctggaccaacgaccggccctccctgacccgtctcgtcgggcctccgagtaccgtaggacggatggaggtcttagtatttaagttactgcacgtcttacaattagttacaggtacaacgacgaaacgtaggggttacgttaccgggacgggtaacgggtaaccgtaacggttacgggaccccgtttacccgtaacgggttaccgaaaccgggtaccccgtaaacggggtcccccgttacccgggtaccccccccggtttacggggttaccccttaaccccgtttaccccggtttccccgggttttcccccccggcccccgtttaacccccgg

SEQ ID NO: 58733 - DNA, 975 bp, Homo sapiens
  misc_feature: GYAE6OF01EIWRU.8.42.D09.1.454.CMB.1.raw
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcacgtcacctatcctccgtgcacgtggacgccaagccgtagttacgtaactttaaccgaaactttatacttccgttacccgttacggtaaacccaaaccgaaacccaaccccgtaacgggaacccaaaaccgtacccccctaaaactacctaacgttacggtttaacgtttttacggtaacgggttaaccgaaaagttaaaccggcccgggtacccgttaccgggaaccggggttacccgttacggaacgttcccgtcccgtttaccgtacggtaccggacccgttaccggtaaaccggttccggtacggaaccgtaacccggtacccggtaccccttccccggtacggtacccccgttcgttccgggtacggtaccccgtaccgtaacgggtaccggttacgggtacgggtacgtacgggtaaccggttcgttaacggttaacgtttaacgtttaaccggtacgtacccgtaacggttaccttaccgttaaagtttccgttaaccggtacgggtaaccgttaccggaaaccggtaacgggttaacggggtttacgggttaacccggggtacggggtaaaccggggtaaccgttaacggggttaccccgtaacccgggttaccggtttaccgggtaacccggtaaccggtaccccgggtaaaccgggttccccggttacccccgggtaacccccgttaccccggtaacccgttacccccggttaacccgtttccccggttaaaccccccgttccccccgttaaaccccgggg

SEQ ID NO: 58734 - DNA, 694 bp, Homo sapiens
  misc_feature: GYAE6OF01AFW9C.8.42.D09.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (490)..(490): a, c, t, g, unknown or other
  misc_feature (490)..(490): n is a, c, g, or t
tcagctcgcgtgtccacgaccggtgctcgatttagacacatacgcagggaaaggggggggtctcgaggaggcagcgctctcaggacgtcaccaccatggcctgggctctgctcctcctcaccctcctcactcagggcacgagggtcctgggcccagtctgccctgactcagccctccgtcgcgtaccgggtctccgtggacagtcacgtcaccattcctcctgcacgtgggacnccgagcctaggtntacttaacaacttntactccgtcctagtaaccaacacccaccgagaccaaccgtaccccaacgtctattagttagttttcgacggttacaacgtaacgccggtcccgtaggacgggtccctagtactccgtcttacacgacgtcctacgaacgtcgtacgaccaccgtaccgtcctccgtacgtcctcgtcgtcggaccttccgagtccgtggacgtagcggtacgtactagtacttacgtancgtaacgtctacgtataccgttagttacgacggactacggtaaccgtaggggttacggttacggaccggggtaccgggaaacggtacccagggtacctccgggtaccgttaaccggtcggtacgaacccggtccggtaacggtccccgtacccgggttccctacggacccgttaccctccgttaacccctcccggtaaaccccg

SEQ ID NO: 58735 - DNA, 713 bp, Homo sapiens
  misc_feature: GYAE6OF01BSSFD.8.42.D09.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
  modified_base (529)..(529): a, c, t, g, unknown or other
  misc_feature (529)..(529): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagccctccctccgccgtccgggtctccgtggacngtccagtccaccatcctcctgcacgtgggacncccagcagtgaacttaccaatntatctccgtacgtaaccaacaaccaccaggaccaaaccgcccccaaactcatagttagttttggagtactaagtacggccgaccgtcggacgggtccctgactccgtcttccgcgtacggcctaccgtaagtccgacggtacctaacgacccggtccctacccgtacggtacccgtccgttcgtcgggcctacgaacgtacggtaggagtgtaggtacgtcgtagtaatttacttacgtcgacgtacgtactactaacgtttacgtaccgngtaaccacggtaaccgtaacgggttaagggttccggtaacggggaccgggtaacgggtaaaccgttaacggttacccggtacccggttaccggtaccggtaccgtaaccggacccgtacgggtcccgtccccgttaccccggttcccggtaacttcccgtccccggtttcccgttcccccccgg

SEQ ID NO: 58736 - DNA, 617 bp, Homo sapiens
  misc_feature: GYAE6OF01CA46I.8.42.D09.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcaggcacagggtcctgggcccagtctgccctgactcaacctccctccgcgtccgggtctcctggacngtcagtcaccatcctcctgcacgtggacnccagcagtgattacaactatactctcctggtaaccaacaaccacccaggaccaaacgaccccaaactcatgtatttgagtnaatacgcgccctgacgggtcctagctcgcttcncaggtctccgatcgngacacacgcctccgcgtccgtctcgtcggccncgagcgtagacggngcggagtcgtagtattacttacgngcncgtcttactagtttacctcgagccgaagactaacgggtaagggttctacggggacggtaacggtacccgtaagttccgtacccggttccggacgtaccggaccgtacccgaacgggtccctcccgggtacccccgtggtacctaacccggttccgttacccgttccccccttacctcccgtaaccccgg

SEQ ID NO: 58737 - DNA, 700 bp, Homo sapiens
  misc_feature: GYAE6OF01AIZXM.8.42.D09.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (349)..(349): a, c, t, g, unknown or other
  misc_feature (349)..(349): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcgaggcacagggtcctgggcccagtctgccctagacctcacgcctcctccgcgttaccggtctaccgtggacngtccacgtcacctagtcctctgccagtggacnccagcagtcgtacttacaagtntatcctcgtcgtacaacacaccagacaacgacccaaacnctactatacgtttagacgtactaagtacggtcgtaccgtacgtaccgggtaccnggtactccgtacttcgtacgtacggtacctaccgtaagttcgacggtaccgtaaccgtaccggttccctacccggttaacgtcccgttaccgttaccggtcggtacctaccggttacgacggttacgacggtacgttacggacgttacggtactaggtttaacgttactcgtacgacgtccgtactactacgtttacggactacgtcgaaacggttacgtaccgggttagttccgggtaacgaccggtacgaacgttcgtaccgacgttaggtaccgcggtaaccgtacggccctacccgggtccctacggtaccttacgttaccccgtaccgttcccccgtcggtacccg

SEQ ID NO: 58738 - DNA, 779 bp, Homo sapiens
  misc_feature: GYAE6OF01DTSLQ.8.42.D09.1.454.CMB.1.raw
  modified_base (143)..(143): a, c, t, g, unknown or other
  misc_feature (143)..(143): n is a, c, g, or t
  modified_base (238)..(238): a, c, t, g, unknown or other
  misc_feature (238)..(238): n is a, c, g, or t
tcagctcgcgtgtccacgaccggtgctcgatttagacacatacgcaggggaaagggggggggtctcaggaggcagcgctctcaggacgtcaccaccatggcctgggctctgctcctcctcaccctcctcactcgagggcacgngggtcctgggcccagtctgccctgactcacgccctccctccgcgtccggtctccgtggacagtcagtccacctatcctcctgcctacgtgggacnccgaagcgtaggtataacttaacaaaccttattaacgttcctacccgttaacggtaaacccaaaaccaaaacccaacccgaacgggaaaccaaaaacccggaccccccaaaaacttcccgtaagttacggtttaacgttttttacggaacggtttaactaaaacgttaaaccgggcccggtaccccgtacggtaccggggttcctaggtacttcgtcgttactacgacgtcctacgacgtcgtacggaacaccgaccggtcccttccgtcgaccgttcgtcgacgggtcctaccgaagtcgttaggaaggtacgtacggtaacgtgttaattaacgtttaacttaacggtcgtacgtaacgtaccttacgtaactttaccgtagaaccgacgtacgtaaaccggtaagtaacggggttacgtaccgggtacgggaacgtaacgtacggttaccgtaccgttaccggacggtacaaccggtacgacggtcccacccggtcccctacggtcctaccttaccggtccctacccgtccctaccgg

SEQ ID NO: 58739 - DNA, 950 bp, Homo sapiens
  misc_feature: GYAE6OF01CCGAK.8.42.D09.1.454.CMB.1.raw
tcagctcgcgtgtccacgaccggtgctcgatttagacacatacgcagggaaaggggtgggagaggagcccagcactgggattccgaggtgtgtccattcggtgatcagcactgaacacagaggactcaccatggagttctggctgggctgggtttttccttgttgcaatttcaaaaggtgtccagtgtgaggtgcagctggtggagaagtgggaggggtcttgatccgagggtcccggggggtccctgacgactctcctgtcgcagccctcgtcggtccttacaccactacaagtacgaacgtactactagtcgaggtccgtccggggccccgccgtacggccgtccgggaaggggacggggcgtagggacgggttgggtccttacgttagttttaacgtttacgtccggtacggtaggttacgggtcgggtaccctaaccgtaaccgtaaccgtaccggtaccgtaaaccggtacccgttaccccggggttaagggaaaccgggggtcctaaaccgggttaacccttttccccgggaaccccgttttaccccgtaccccggtaaacgggtaaaaccgtaaccccggtttaaaaaccgtttaacccggaaaaaccggttaacccggttaaacgggtttttaggggtttaaaccggttttaactttttaacccgtttaaaaccggtaaaaaacgttttacccggggaaaacctaaaacccggggttaaaaccctttaaaaccgggaacccgggttaaccccgggaaaccgggtaaccccgggtaaccccgggttaccgtttaaaccgttttaacggttttaccggtacgggttacggtaacccgggtaagtaaccccggttaagttacccgggttaaacgggttaccggggttaccggtaaccccggggtcccccgggtaacgggggggtcccccgtaaaaccccgggggg

SEQ ID NO: 58740 - DNA, 857 bp, Homo sapiens
  misc_feature: GYAE6OF01A9C1V.8.42.D09.1.454.CMB.1.raw
tcagctcgcgtgtccacgaccggtgctcgatttagacacatacgcgagggaaaggggggctggggtctcaggaggcagcgctctcaggacgtccaccaccatggcctggctctgctcctcctcaccctcctcactcacgggcacgacgggttcctcgggtcccagtctcgccctgactcacgcccttccctccggtcgtccgggtcctccgtggacaggtccacgtccaccacttctcctagcacgtggacgccgacgtcgagtacgtaacttaaccgaaacttactactacccttacccgtacggtaacccaaaccaaccccaacccgtaacggaacccaaaccgaacccccctaaactaccgtaagtacgttaacgtttttacggacgttaaccgtaaaacgtaccggacccggtcccgtacggaccgggttccctaggtacgttccgtccgttactacggtaccggtccgtaccgaacggtccgtacggacccgaacgtcccggtacccctaccgtaccgaccgtttcgccgttacgggtacctaccgtacgtacggtacggaacggtacgtagggtacgtaccgtttaaggttacttaacgtttcgtacgtacgtaccgtaccttaacggttataaccgtcgaaccgggtactaaaccggaccggttaacggttacggggttaacggacccgggacgggtaacccggtaaaccggttacgggtaccgtaaccgggttacccgttaaacgggtaccgggtacccggttaacccggaacccgggttcccgacccccggtcccccggttacggttaaccccgttcccggttcccgtttaacccccggtaccccccg

SEQ ID NO: 58741 - DNA, 675 bp, Homo sapiens
  misc_feature: GYAE6OF01CVAN1.8.42.D09.1.454.CMB.1.raw
  modified_base (122)..(122): a, c, t, g, unknown or other
  misc_feature (122)..(122): n is a, c, g, or t
  modified_base (124)..(124): a, c, t, g, unknown or other
  misc_feature (124)..(124): n is a, c, g, or t
  modified_base (129)..(129): a, c, t, g, unknown or other
  misc_feature (129)..(129): n is a, c, g, or t
  modified_base (131)..(131): a, c, t, g, unknown or other
  misc_feature (131)..(131): n is a, c, g, or t
  modified_base (133)..(133): a, c, t, g, unknown or other
  misc_feature (133)..(133): n is a, c, g, or t
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
  modified_base (631)..(631): a, c, t, g, unknown or other
  misc_feature (631)..(631): n is a, c, g, or t
tcagctcgcgtgtccacgaccggtgctcgatttagacacatacgcaggggaaagggggctggggtctcagggaggcagcgctctcaggacgtcaccacatcggcctgggctctcgctcctcncncctcncncncgacggcacggtcggtcgtcggcctagtcgcgcctacgtacncgacgcctccgcgtcggtcggtctcgcgacncgacacgtcactctcctcgtcacacgtacgacgcagcagtacaactacactactctcctacgtacgaacaaacaccaacgacgaacaaccaccanctagtagtttacgttaggacgtaacaacgtacggccgtcggtcggtacggtctacgcgtcgtactcgacgtactcgtaacgtcgtcgacgaaccgacggtccgtccgtcgtacgcgttcgcgtcgtcacgtacgacgtaggagtacgtacgtcggtaacttaggttactttacgacgtcgacttacgtctaacgttacttagggaccgagtaccggtaacgaacgggttaacggttacgggtaacgggttccggggaacggtaacgttaaccgggtacggtccggtaccggtaacgttaccggacgtaaccggggtactaccgggtcccnccgggttaccgtaactccggtttcctcccgttcccggtaacccg

SEQ ID NO: 58742 - DNA, 785 bp, Homo sapiens
  misc_feature: GYAE6OF01EXWY9.8.42.D09.1.454.CMB.1.raw
  modified_base (556)..(556): a, c, t, g, unknown or other
  misc_feature (556)..(556): n is a, c, g, or t
tcagctcgcgtgtccacgaccggtgctcgatttagacacatacgcaggggaaagggggggggtctcaggaggcagcgctctcaggacgtcaccaccatggcctgggctctgctcctcctccacccctcctcactcgagggcacgagggtcctcgggcccagtctcgccctgactcacgccctcccgtccgtccggtccgggtcctccgtcggactacgtcacgtccaccacttcctcctgccacgtggacgccagccgagtagtaacttacaacttatactccttaccgtacgtaaacccaaccaaacccgacccgaacggaacccaaaccaccccctaaaactccgtagttacgtttagttttacggaaggttaccaaagttaccggcccggtacccgtacggaccgggttccctagtactcgtaccttcgcacggtcctaacgtacgtcgacgaccacgaccgtccctcgcgtaccgtcgtaccgtcgggtacaccgaacggtcgtacgggaaggtacgacggtacggtcttaaaggttaacttacgggttacncgaacgttacgtcctttaacgactttaccgtaggaaccgtacgaacggaaaccgtaacgggttacgggttacggtaccgggggaacggtaaccggtaacgggttaacggtccggtacccggtttaaggacccggttcgaaccggtacccgtaccggggtcccctccccggggaacccttccggttacctaccccgtttccccgtaccccgttcccctacccggtacccg

SEQ ID NO: 58743 - DNA, 730 bp, Homo sapiens
  misc_feature: GYAE6OF01D3Z1T.8.42.D09.1.454.CMB.1.raw
  modified_base (143)..(143): a, c, t, g, unknown or other
  misc_feature (143)..(143): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
tcagctcgcgtgtccacgaccggtgctcgatttagacacatacgcaggggaaagggggggggtctcaggaggcagcgctctcaggacgtcaaccaccatggcctgggctctgctccctcctcaccctctcactcagggcacgngggtcctgggcccagtctgccctgactcagccctcctccgcggtccggtctcgtggaccagtcagtccacctatcctcctaggacctacgtcgggactacccganccgtaaggtntaactttacgaaacttactacttcctccggtagtaacccaaaccgaaccctaccgaacggaccaaacccgacccaaactcactcggttaattttagaagttacaaagtacgccggtacccgacggtaccgggtcctagctacgtccttactccgaggtcctacgagttcgcggaaccaccgaccggtccctccggtcgtacccgtctcggtacggtcccacgagtaccggtagacggtaagtcggacgttgtagttaatttacgtactcgtaagtctacctattaactacggttacgagtaccgtacgaacggttaacggacgggttacggtacgggtacgggaacgtacggttaaggttaccggacccggttacgtaccgtaacgggaacccggtaccgtcggtacccgacccccttcccgggtaccctacgttccccgttacggtacccccttccccggtccgtaccccg

SEQ ID NO: 58744 - DNA, 718 bp, Homo sapiens
  misc_feature: GYAE6OF01C9TNG.8.42.D09.1.454.CMB.1.raw
  modified_base (173)..(173): a, c, t, g, unknown or other
  misc_feature (173)..(173): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctccaccctcctcactcagggcacgagggtcctcgggcccagtctgccctgactcacnccctccctccgcgtccgggtctccgtggacagtcacgtcacctatcctcctgcctacgtggaacgccagtctacggtgtaacttaacaaacttatactcctccgtacggtaacccaaaccaaccacccgaggaccaaaccggaccccaaaactcaagttgttagtttacgacggtacaagtacgccgtcccgtacggacgggtcctgtactccgtacttccacgtacggtcctaccgaagtccgacggaccaccgacccggtcccctaccgtccgtacccgtcgttaccgtcggtaccaccgagtacgtaggaggtcgtacggacgtcgttagttactttactcgacgtctacgacttactgttacttacgacgggcgtaacgaccgtaaggttaccgggtcggtaacgggccggaagttacccggtaggttaccctaccggttaccggtaggtaccgacccggtaaccggtccgtccggtacccccggtcccttaccggttccctacccgtttcccggttccccgccccccgttccgtacccgg

SEQ ID NO: 58745 - DNA, 826 bp, Homo sapiens
  misc_feature: GYAE6OF01E4UMO.8.42.D09.1.454.CMB.1.raw
  modified_base (567)..(567): a, c, t, g, unknown or other
  misc_feature (567)..(567): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcgagggcacgagggttccgtcgggcccagtctcgccctgacctcacgccctccctccgccggtcccgggtcctccgtggacagtcagtccacctactcctcctgcacgtcggacgccgagcgtaggtagtaacttaacctaacttacgttactccgttaccgtacggtaacccaaacctaaacccgacccgaacggaaccaaaacccgaacccccgtaaacacgtattacgtttacgttttggaacggtactaaacgtaacggcccgtccgtaccggtacggtcccttagacgtccgttcctcgtacgacggtcctacgacgtcgacggcaaccgtcccggcccttcccgtacgtcccgttcgtaccggtcggtccttacgacggttaccgtaggtacggtagtacgggacgttacttagttaactttagttaccncgggtacctcggtaaccttcgttaaccgttaggtaccggaacggaccgaacgtaaccggaacggggttaccggtttaacggggtacccggggacgggttaacgggtaaccggttaacggttaccgtacccgggtttacggaaccgtaccgggtaaccccgtacgggtaaccccggtcccggttacccccggtaccccgttcgggtaacccttccccggttacccgtttccccggtttacccccccgaccgtttaccccg

SEQ ID NO: 58746 - DNA, 708 bp, Homo sapiens
  misc_feature: GYAE6OF01BALF5.8.42.D09.1.454.CMB.1.raw
  modified_base (227)..(227): a, c, t, g, unknown or other
  misc_feature (227)..(227): n is a, c, g, or t
  modified_base (370)..(370): a, c, t, g, unknown or other
  misc_feature (370)..(370): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggacnccagcagtgaattacaactatactctcctacgtaaccaaccaaccaccaggaccaaaccgaccccaactctatgttagttttagaaggtacaagtacggccggtacccgtacggacggggttccctagtactccgtccttacncgtacggtcctaccgaacgtcgtacggaccaacgacccggtcccctacccgtcggtacccgttcgtccggtcgggtccctaccggacgtacgtgggaacggtagtaggacggtacttaaggtaactttaacgttacgacgtactacggtacttactaattagtaccgacggtacgaacgtaacgaaggttacgggttacgttcggggaacggtacgggtaaaccgtggtaccgtaccgttccggtacgggtaccaccgggtaccgacggtcccgtacccggtccccgttacggttaccctaccgttaccccgttcccgtcccccgtaccccgtcccgg

SEQ ID NO: 58747 - DNA, 829 bp, Homo sapiens
  misc_feature: GYAE6OF01DXVK3.8.42.D09.1.454.CMB.1.raw
  modified_base (228)..(228): a, c, t, g, unknown or other
  misc_feature (228)..(228): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacgagggtcctcgggcccagtctgccctgactcagcctcctcgcgtcggtctcctggacagtcagtcaccatcctcctgccacgtggacnccagcagtcgaattacaactagtatcctccgtacgtaaccaaacctaacaccccgaaggaccaaaaccgaccccctaaaactccgtattacgtttaagtttttacggaacggttacaaacggtaacggccggtaccctacgggtaccggggttccctagtacgtccgtccttaccgtcgacgggtccttaccgaacgttcgtaaggaccctaacccgtacccggtccctacccgtcgtacccggtcttccggtcgggtacctaccgaacggtaccgttagggaaggtacgtacgggtaacggttcgttacggttaactttaacgttccttacgggccgtaacctaccgtttacgtaattttaaccggttccggaaacggtaccgtaaagtaacccgggttaaaaggtaccgggggtttaccggttacggggaaccggggttaacgggttaacccggttaaggggttacccgtacccgggtaccgtaacgggttacccggaacccggacccggaaccgggttccctaccccgggtcccccgtttacgggtacccttccgttaccccgggtttaccccttacccccgtaccccggttaccccg

SEQ ID NO: 58748 - DNA, 729 bp, Homo sapiens
  misc_feature: GYAE6OF01EB9CQ.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctccaccctcctcactcgagggcacacgggtcctcgggcccagtctcgccctgactcacgtccctcccgtccgccggtccgggtctccgtcggacagtcacgtcacctattcctcctcgccacgtcggacgccagcagtgaactttaacaacttattacgtccttaccgtaccggtaaccaaccgaacccaacccgaacggaaccgaaaacccgaccccctaaactcctaagttacggtttacgttttacggaacggttaactaacgttaaccggccggtacccgtcggtaccgggttccctagtactccgttccttaccgtaccgacgtcctaccgtaagtccgtacggaccaaaccgtccgtccctaccgtacgtaccgtacgttcggtcgggtcctacgtacggtacgtaggacggtagtacggacggtcttagttaacgtttcttacggtcgtacgacttctacgtactttacgtcggaacgcgaacgtacgtaaggttacggttacggtcgggacggtaacggacttacggtcgtaccggtacgtacggactacggacccgacggtccctaccgtcccgtaccgtctcccgttcgtcccggtcccc

SEQ ID NO: 58749 - DNA, 748 bp, Homo sapiens
  misc_feature: GYAE6OF01DSHY8.8.42.D09.1.454.CMB.1.raw
  modified_base (392)..(392): a, c, t, g, unknown or other
  misc_feature (392)..(392): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacgagggtcctcgggcccagtctgccctgactcacgcctccctccgccgtccgggtctcctgacagtcacgtcaccatcctctgccactggacgccagcagtagtacttaacaactatactctaccgtacgtaaccaaccaaccaacccgacggaaccaaaccgtaccccaaactcaacttacgttagtttttaggacggtacaaacgtaacggccggtacccgtcggacggggtcccctagactcgtccttacncgtagctacctaagtcgtacgaccgacgaccgtcctccgtcgacccgttctccggtcggtaccctacgactaccggtagacggtagtcggaaggtcctttagtaacttttacgtacgtacgacgtacgtaccttaacgttacctttacgtcggtacggacgaacttaacggaaaccggtggggtttaacccggcggggtaaccggtaacggggaccttaacggttacccgtaccggttaccggttagggtacccgaacggtaccccggtaacgggtcccgtaccccccggtcccggttaccggtacccgttaccccgttcccggttacccccgttcccccgcccgttaacccccgg

SEQ ID NO: 58750 - DNA, 729 bp, Homo sapiens
  misc_feature: GYAE6OF01A0SFD.8.42.D09.1.454.CMB.1.raw
  modified_base (232)..(232): a, c, t, g, unknown or other
  misc_feature (232)..(232): n is a, c, g, or t
  modified_base (668)..(668): a, c, t, g, unknown or other
  misc_feature (668)..(668): n is a, c, g, or t
tcagctcgcgtgtccacgaccggtgctcgatttagacacatacgcgaggggaaaggggggggtctcgagggaggcagcgctctcaggacgtcaccaccatggcctgggctctgctcctcctcaccctcctcactcagggcacgagggtcctgggcccagtctcgccctgactcacgtccctccctcggcgtccggtctccgtggcagtcacgtcaccattcgcctgctacgnggacgccagccaggttcgattaccaactactacgttcctccgtacggtaccaaccaacacccgacggacaaccgaccccaactcagttacgtagtttttggagtactaagtaacgccggtcctacggagggtccctaggtctcgcctttcgacgtacgtcctacgtacgtcgtaggacacgccgtccgtcctacgtccgtctcggtcgcctacgacgtaccaggtacgtcgtacggcgtacgtagttaacttacgttacgtcgtacgttaccgacttacgtacgttacgttaccggacgtacgtaccgaaccgttaacggaccggggtttacgtaccggggacgggttaacgggttaccgtaacggtccgggttaacccgttcggtaaccgggttacccgacgtaccccggttaccgggtcccgggttaacccccncccgggtttaccgcggtttaccccctacgttacccccggttccccctaccgttacccccgg

SEQ ID NO: 58751 - DNA, 710 bp, Homo sapiens
  misc_feature: GYAE6OF01ETGJ5.8.42.D09.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (481)..(481): a, c, t, g, unknown or other
  misc_feature (481)..(481): n is a, c, g, or t
tcagctcgcgtgtccacgaccggtgctcgatttagacacatacgcagggaaagggggggggtctcaggaggcagcgctctcaggacgtcaccaccatggcctgggctcttctcctcctcaccctcctcactcagggcacgagggtcctgggcccagtctgccctgactcacgcctccctccgcgtccgggtctccgtggaacagtcacgtccacctatctcctgcacgtgggancaggacagtgattacaactatacnctcctaggtaccaacaacaccaggacaaaccgacccaaactacactagtattttagaggtacaaagtaacgccggtaccctaggaccggggtcctagactcgtaccttgtcgacggcctaccgtacgtntacggacaaccgacgtacccctccncgtacccgtcctacgtaccgggctacgacgcgttaggaggtatggacgtcgtagtaactttagttaacnggtctaacgtccgtactaattaccgtaactacccggagtaacgaaccgttaaggttacgggtaacggttaccggggaacggtaaaccgggtaactaaccggggttacgtaccccgtaacgggttacgaccgtaaccgcccgggtaacggtcccggtaccccggacccccgtttcggacccgttaacccttcgttacccccgttacccctacccggtcccttaaccgggg

SEQ ID NO: 58752 - DNA, 905 bp, Homo sapiens
  misc_feature: GYAE6OF01D8MZ8.8.42.D09.1.454.CMB.1.raw
tcagctcgcgtgtccacgaccggtgctcgatttagacacatacgcatggaaagggggggagaggagcccagcactgggattccgaggtgtgtccattcggtgatcagcactgaacacagaggactcaccatggagttcgtggcgtgggcttcggggtttttccttgttgactaatttacgaaaaggtgtccagtgtggaggtgcagcgtggtaggagaaggtggggaggggtcttggacgtccggacggggtcccggggggtcctaggacgacctcctccgtggtcgacgcgtcctcgtacggtccttaccaccagtactaagtacgaacgtacttacgagtacggacgccggtccgggaccccggtaccggacgggtcccgtaaccgggaggggggtacggggtcggttacggggtacgggttcgggttaccgttacggttaacgttttactttacggtacggtacggtaggtacgggtacggaacctaccgaacgtaaccggtaccgaccgtaacggtacccgtaccgggtagggaaccgggtataacgttacccgttaccgaccgttaccgtaaacgaacgttaaacgtaaccgttaaaccgtaacgaaacggttaacgtcgggttaaccgttaagttttaaccgttacttaaaccgaaaacgtaaccgggttaaaaccaacggttaaaccgtaaacccggacgggtaaccccgggtaaccggaccgggttaaacccggttaaacggtttactttaaaccggtttaccgggttagggtacccggaaagggttaacgtaaaccgttaacgggttaccggaaaccccggggtttacgggacccgggaaccccgggggtttaaccccgggggtaccggggaaaccccggggtttaaccccggggg

SEQ ID NO: 58753 - DNA, 982 bp, Homo sapiens
  misc_feature: GYAE6OF01BPGCS.8.42.D09.1.454.CMB.1.raw
tcagctcgcgtgtccacgaccggtgctcgatttagacacatacgcagggaaaggggtctgggagaggagcccagcactgggattccgaggtgtgtccattcggtgatcagcactgaacacagaggactcaccatggagttcgtggcgtgggtcgttggttttccttggttgactaatttacgaaaggtgtacctagttgtggaggtgcgtggcgttgggtaggaagtaaggtggggtaggggtcttggacgtcccggacgggcccgggggggtccctaggacgtaccgttccgtccgttggtacgccgtacggtcccgttcgtccggttaccctttaccgaacccttacgttaccgaaaggttaaacggtaaccgtaaccgttaaccgtacggttacggacccgggtaccgggttacccggggccccccggtacccggacgggtaccccggttaccgggggaaaggggggtacgggggtcggttacggggtaacggggtttcggggttaccgtttaaccggtttacggttttaaacttttcggtaccgggtacgggttaggttcggggtaccgtaaccgtaaccgtaacccgtaaaccggtaacccggtaccggtaacccggttaacccggttacccggggtaaagggtaaccggggtaacttaaccggttaccgtttacccgtaaccccgttcccgtaaccggtaacgtaacgtaaacccgttaaccgtttaaaccggaaaccgtaaacggttacggttacggtttagttaacccgtttaaccgtttaacggaaacgtttaaccgaaacggttaacccgtaaaccgttaaaccggtaacccggtacccggtaaccgggtaaccgtaccggttacccgttaagttaaccgttaccgtacgggtacgtaaccggtaacgtacgttaacgtaccggtacgggttaccggagggtccccggtacccggggtcgggtaaccccggg

SEQ ID NO: 58754 - DNA, 765 bp, Homo sapiens
  misc_feature: GYAE6OF01CQ6RF.8.42.D09.1.454.CMB.1.raw
  modified_base (253)..(253): a, c, t, g, unknown or other
  misc_feature (253)..(253): n is a, c, g, or t
tcagctcgcgtgtccacgaccggtgctcgatttagacacatacgcagggaaagggggctgggggtctcaggaggcagcgctctcaggacgtcaccaccatggcctgggctctgctcctcctcaccctcctcactcgacgggccacgacggggtcctgggcccctagtctcgccctgactcacgcctccctcgccgtccgggtctccgtaggactagtcagtccacctatcctcctcgactaacgtcgggaccncgacgctaggttcaacttacaactattacttcctacgtacggtaaccaaacaaccgaaccgaacggaccaaaccgacccctaaatccaagttcgtagttttacgacgtacgaaactaacgccggtacctcgggtaccggtaccgtagtaacgtccgtactcgaccgtacgtacctaaccgtacggttaccgacgtaccgtaaaccggtacccggtccctacccgtacggaccccgttaccgtccggtaccggtccctaccgtaaccggtacggtacggtacgacggttagggtaccggttttaaacggttactttaacttacggcgtaacgtcgttccgtaagttacgttacgttacgacgtacgaacgtacgtacggtaggtacgggtacgggaccggtaacggtaccgtacggtaccgtccgggtaaccgtacgggcccgaaaccggccggtaccggtacccgtcccgtacccggttacttacccgaccgttcccttaccccggtacccc

SEQ ID NO: 58755 - DNA, 814 bp, Homo sapiens
  misc_feature: GYAE6OF01AHSGK.8.42.D09.1.454.CMB.1.raw
  modified_base (789)..(789): a, c, t, g, unknown or other
  misc_feature (789)..(789): n is a, c, g, or t
tcagctcgcgtgtccacgaccggtgctcgatttagacacatacgcagggaaaggggggggtctcaggaggcagcgctctcaggacgtcaccaccatggcctggctctgctcctcctcaccctctcactcgagggcacgagggtcctagggcccagtcctcgccctgactcacgccctacccgtcgcggttccgggtactccgtggacagtcagtccacgtacttccgtaccgtgacctacgtaggacgtaccgagcctaggtacgtaacttaactaacttagttaccttcctaccgttaacggtaaccctaaaccgaccgaacccgaggaacccaaaccgtaccccaaagttccaagttacgtttagttttacggaacggtttacaaagtaccggcccggtaccgttaccgggaccgggttcctaggtacttccgttaacgttcgtaccgagtacctaccggtacgtacggttccgaaccgtaaccggtacccgggtcccttaaccggttaccggtacccgttcgtttaccggaccgggtaccttaccgggaacgttaccggtagggtaaccgtaggtaccggtcggttacccttaaggtaaccttttcggttaacgccgggtaacttacggtacccttagtaacgtttaccgtagaccggaaccgtagtaaccggacgggtttacggttaccgggtacggttaccgggaacggttacccgttagggtaccggccgttaaccggcgttaaccggacgtccgaaccgttccgtacccgcccgttacgtcnccctttacggcccctacgcctaccg

SEQ ID NO: 58756 - DNA, 769 bp, Homo sapiens
  misc_feature: GYAE6OF01CB6I4.8.42.D09.1.454.CMB.1.raw
  modified_base (235)..(235): a, c, t, g, unknown or other
  misc_feature (235)..(235): n is a, c, g, or t
  modified_base (733)..(733): a, c, t, g, unknown or other
  misc_feature (733)..(733): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacgtagggtcctgggcccagtctcgccctgactcacgccctcccgtccgcggttcccggtctccgtggactacgtcacgtcaccagttcctctgaccncgtacggcgccgaagtcagttacgtaactttaacaacttcttactccttaccgttacggaaccaaaccaaccgaccaacggtaccaaaaccgccccaaactcctattagtttagttttacggaacgttacgtaacgtaacggcccggtaccgtaccgggtaccgggtccctagtaccgttccggtacttcgtaccgcgtccgttaacgaggttcgtaccggaacgaaccgtccggtccctaccggtacggttaccgtcgtcggtccgggtcctacggtacgcggttacggagtacggtggtaccgtacgttgttaacgtttacgtacgtcgtacgtaactcgtaacgtagtttcggtaacggcgtacgtacggaacttaacggggtacgggtttacggaccggggaaccgtaacgggtacgtaacggtcccggttaacgtccggtaacgtccgacccggtaccgaccgttcccggtacctaccgggtcccgtttaacncccgtttaaccggtccccttaacccgcccgtaccgg

SEQ ID NO: 58757 - DNA, 692 bp, Homo sapiens
  misc_feature: GYAE6OF01CB80P.8.42.D09.1.454.CMB.1.raw
  modified_base (146)..(146): a, c, t, g, unknown or other
  misc_feature (146)..(146): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (360)..(360): a, c, t, g, unknown or other
  misc_feature (360)..(360): n is a, c, g, or t
  modified_base (647)..(647): a, c, t, g, unknown or other
  misc_feature (647)..(647): n is a, c, g, or t
tcagctcgcgtgtccacgaccggtgctcgatttagacacatacgcaggggaaagggggggggtctcaggaggcagcgctctcgaggacgtcaccaccatggcctgggctctgctcctcctccaccctcctcactcgagggcaacgngggtcctcgggcccagtctcgccctgactcacgccctcccgtccggcggtccggtcctccgtggacngtcagtccacntcctctgcactaggcncgagcgagtagtataacatntactctccgtacgaaccaacaccaccgagaccaaccgacccaaatctagttcttagtttaggacggtaacaacgtacggccgtcccgtagggtacgtccngtctccgtacctcgcgtcgacctacgtagtcgtacgaccacgcccgtcctacgtcgcctcgtccgtcggtacctaccgagtaccgtggaacggtgacggtaggtaccgttaattacgttaacgttgaccgtacgacgttacctagttaactcggacgtaacgcgaacggtaacctacggggtacgggttacggtaccggggacggttaaccggtacggttaacgggtcccgtaccggtaccggttacgaccggaccggtaccgacccggttcccgacccggttcccncggttaccctccggttaacccgttccccgtaccctcccgtccggg

SEQ ID NO: 58758 - DNA, 804 bp, Homo sapiens
  misc_feature: GYAE6OF01BQKPB.8.42.D09.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
tcagctcgcgtgtccacgaccggtgctcgatttagacacatacgcaggggaaagggggggggtctcaggaggcagcgctctcaggacgtcaccaccaatggcctgggctctgctcctcctcaccctcctcactcagggcacgagggtcctgggcccagtcctgccctgactcagcctccctccgcgtccggtctccgtggacngtcagtcaccattcctctgcaccgtggganccagcagtntaacttaacaactatactcctacctacggtaaccaacaaccacccgtaacggacaaaccgaccccctaaatccattagttacttttacggaagttactaaagtaaccgccggtaccctacggtaccgggtccctagtacttccgtcgttccgtacgaccggtacctaccgtaagtccgacggtaccaaaccgaccggtccctaccgtcgtaccgttcgtacgtcgggtacctaccgtaagtacgtacggaggtacgtcggtagttcgttaagttaacgtttaattaccggacgtacgtaaccggttacttacgtaatttacgtacggacggaacgtaaacgtaccggtaaacggtaacggggtttaccggttaacgggggaccgggttaaacgggtacccggtaaaggtttacccgggtaacccggttaccggttacgggtaaccctaaccggggaacccctaacgggtcccgttaacccccgggtcccccggtttaaaccgttcccggaccccgtttaccccggtttacccggtttaccccccccaacgggttaccccccg

SEQ ID NO: 58759 - DNA, 810 bp, Homo sapiens
  misc_feature: GYAE6OF01DJDYN.8.42.D09.1.454.CMB.1.raw
  modified_base (145)..(145): a, c, t, g, unknown or other
  misc_feature (145)..(145): n is a, c, g, or t
tcagctcgcgtgtccacgaccggtgctcgatttagacacatacgcaggggaaaggggggggtctcaggaggcagcgctctcaggactcaccaccatggcctgggctctgcctccctcctccaccctcctcactcgagggcaacgngggtcctgggcccagtctcgccctgacctcactccctcccgtccggccgtccgggtcctccgtacgacacgtcacgtacaaccctatcctcctgcctacgtggacgccagcagtataacttaacaactatctctacgtacgtaaaccaacaaccgaccgaaggaacccaaaacccgacccctaaatcgtaacgttcgttttaagtttaggaaaccggtaataacggtaaccggtcccggtaccccgtgggtacccggggtaccctaggtaacctccgttccttaccgacgtccggtaccctacgttaacggtccgtaacggacccaaaccggtcccggtacccgttcccgaacggttccccgtcgttcgggtaccgtcctaccgtagtaccgggtagacggtagtaccggagttagttaacggttaactttacgtcgtagacctacgttacctaacgtttaagttcgtaccggaacgtaccgtaacggtaaccgtaaaccggggttgggttacccgggaaccgggggtaacgtaaccgggttaccgtacgttaacccgggtacgtacccgtagggacccctaccggtaacccgcccggttcccgaaccccgttccggtaccgttccttaaccggttcccgtttacccgccccgtaccgtaacccg

SEQ ID NO: 58760 - DNA, 789 bp, Homo sapiens
  misc_feature: GYAE6OF01BENO6.8.42.D09.1.454.CMB.1.raw
  modified_base (346)..(346): a, c, t, g, unknown or other
  misc_feature (346)..(346): n is a, c, g, or t
tcagctcgcgtgtccacgaccggtgctcgatttagacacatacgcagggggaaaggggggggtctcaggaggcagcgctctcaggacgtcaccaccatggcctgggctctgctcctcctcaccctcctcactcagggcacgacgggtcctgggccagtctcgccctgactcacgcctcccgtccgccgtccgggtctccgtggaccagtcacgtcacccatccgtcctgcacgtggacgccagcagtgaacttacaactactacttcctccgtacggtaaccaaacctaaccaccacggtaaccaaaccgaaccccaaactaccatacgtaattttacgacgttanaagtaaccggcggtaccgtcgtaccggggtcctcgtaacgtcgttcccgttacgttcgaccggtccttaccgacgtaccgacggtaccgaacgtacccggtcccttaccggaccgttacccgtcccgtcgtacgggtccctacgaccgtaacggtcggaggtacggtagtacgggtacttacggtatttacgtttaccgtcgtacggtactcgtaccttagtaacgtaccgagttaacgacgtaccgggttaacggtacggttacggttacgggtaacgggtacggtaaccggttaacgggtaaccggtaccggttaaccggtaccgggtacccgttaacccgggaacccggttacgggcccgttacccgggtacccccttacgggttaaccccgacccggtttccccgttaacccttccccggggttaaccccttaccccgg

SEQ ID NO: 58761 - DNA, 632 bp, Homo sapiens
  misc_feature: GYAE6OF01A7DJO.8.42.D09.1.454.CMB.1.raw
  modified_base (417)..(417): a, c, t, g, unknown or other
  misc_feature (417)..(417): n is a, c, g, or t
tcagctcgcgtgtccacgaccggtgctcgatttagacacatacgcaagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggagccagcagtgattacaactatactctctggtaccaacaacacccaggaccaacgaccccaaactcatgtacttttgagtcaatacgcgcctcgacgggtcctgatcgtctctcaggcctacgtaagtcgtcgacaacgaccgtcctcctacgacccgtctcgtcggtcctacgagactagacggtcaggcggtnttagtacttagttacgtgacgtagtcctactacgttacttacgtagggctaaggacctaacggtagggttacgtccggggacggtacggtaccgaacgggttccgtaccgttaccggtaaggtaccgaccggtaacccgaacggtcccgttccccgaccccgtttccggtacccgtaacgtttcccgtacccgtttcccccgtacccggtccccg

SEQ ID NO: 58762 - DNA, 527 bp, Homo sapiens
  misc_feature: GYAE6OF02H96A8.8.42.D09.1.454.CMB.1.raw
  modified_base (413)..(413): a, c, t, g, unknown or other
  misc_feature (413)..(413): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacaccaggcaaagccccaaaactcatgattttgaggtcaataagcgcctcagggtccctgatcgcttctcaggctccaagtctggcaacacggcctccctgacccgtctctcggctccagactgaggatgaggctagattatactgcagtctnatatcagcaagcaacagggtacttcggacgggaggaccaagttcgaccgtctaggtcacggcccaagggcctcgcccccgtggtaccacttccgtcgttaccccacccttcccg

SEQ ID NO: 58763 - DNA, 540 bp, Homo sapiens
  misc_feature: GYAE6OF02IPW9H.8.42.D09.1.454.CMB.1.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagccagcagtgattacaactatatctcctggtaccaacaacacccaggcaaagcccccaaactcatgattttgaggtcaatagcggcctcgaggggtccctgatcgcttctcaggctccaagtctggcaacgacggcctccctgacccgtctctgggcctccagactgaggatggagctgattattactgcagctcattactcaggcagacaacgagggtattcgggacggacgggacaagttcgaccgtcgtaggtcgacgacccgaaggctccgccccgtcggtccaccgttccgtccggttccccacccgtcccg

SEQ ID NO: 58764 - DNA, 510 bp, Homo sapiens
  misc_feature: GYAE6OF02GMLW2.8.42.D09.1.454.CMB.1.raw
  modified_base (404)..(404): a, c, t, g, unknown or other
  misc_feature (404)..(404): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggcctcagggtccctgatcgcttctcaggctccaagtctggcaacacggcctcctgaccgtctctggcctccagactgagatgaggctgattattacngcagctcatatcaggcagcaacgaggtattcggcggaggaccaagttcgaccgtctaggtcgagcccaaggctcgcccctggtccacgtctcgttcccgcctcccg

SEQ ID NO: 58765 - DNA, 509 bp, Homo sapiens
  misc_feature: GYAE6OF02FVFD6.8.42.D09.1.454.CMB.1.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagttaccatctcctgcactgganccagcagtgattacaactatatctcctggtaccaacaacacccaggcaaagcccccaaactcatgatttttgaggtcaataagcggccctcaggggtcctgatcgcttctcaggctccaagtctggcaacacggcctcctgaccgtctctgggctccagactgagatgaggctgattatactgcagctcatattcaggtcagcaacgaggtatcggcgagggaccaagttgaccgtctacgtcagcccaaggctcgcccctggccactctcgtcccacctctaccg

SEQ ID NO: 58766 - DNA, 517 bp, Homo sapiens
  misc_feature: GYAE6OF02G06T3.8.42.D09.1.454.CMB.1.raw
  modified_base (223)..(223): a, c, t, g, unknown or other
  misc_feature (223)..(223): n is a, c, g, or t
  modified_base (436)..(436): a, c, t, g, unknown or other
  misc_feature (436)..(436): n is a, c, g, or t
  modified_base (510)..(510): a, c, t, g, unknown or other
  misc_feature (510)..(510): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaagcccccaaactcatgatttttgaggtcaataagcggccctcaggggtccctgatcgcttctcaggctcaagtctggcaacacggcctccctgacccgtctctcgggcctccgagactgaggatggaggctgattattactgcagctcatatcagcagcaacgngggtactcggcggacgggaccaagtcgaccgtctaggtcgacgccgaggctcgcccgtcgcactctcgttcccnccctccg

SEQ ID NO: 58767 - DNA, 522 bp, Homo sapiens
  misc_feature: GYAE6OF02F7TXF.8.42.D09.1.454.CMB.1.raw
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctgtaccaacaacaccaggcaaagcccccaaactcatgattttgaggtcaataagcgccctcagggtccctgatcgcttctcagctccaagtctggcaacacggcctccctgaccgtctctcggctccagactgaggatgagctgattattacngcagctcatnttcagcagcaacagggtatcgggcggaggacctaagtcgaccgtcgtaggtcgaacgcccaaggcctacgcccccgttcggcctacgtcctacgttccccaaccttcccg

SEQ ID NO: 58768 - DNA, 520 bp, Homo sapiens
  misc_feature: GYAE6OF02GUDR1.8.42.D09.1.454.CMB.1.raw
  modified_base (336)..(336): a, c, t, g, unknown or other
  misc_feature (336)..(336): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (512)..(512): a, c, t, g, unknown or other
  misc_feature (512)..(512): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacaccaggcaaacgccccaaactcatgattttgaggtcaataacgcggccctcgacggggtccctgatcgcttcncaggctcagtctggcaacacggcctccctgacccgtctcgtcggcctccagactgaggatgaggctgattatactgcagctnatntcgngcagcaagtggtatcggcgaggacaagtcgaccgtcgtaggtcacgcccaaggcctcgccccgtcggcctacctccgtcgttccccnccctaccg

SEQ ID NO: 58769 - DNA, 516 bp, Homo sapiens
  misc_feature: GYAE6OF02FHTA1.8.42.D09.1.454.CMB.1.raw
  modified_base (503)..(503): a, c, t, g, unknown or other
  misc_feature (503)..(503): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggcctcagggtccctgatcgcttctcaggctccaagtctggcaacacggcctccctgaccgtctctgggctccagactgaggatgaggctgattattactgcagctcatacttcagcagacaacgagggttatcggacggaggaccaagttcgaccgtccgtaggtccagcccaaggcctcgcccctcggtcncctctcgtccccg

SEQ ID NO: 58770 - DNA, 519 bp, Homo sapiens
  misc_feature: GYAE6OF02F76MH.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacaccaggcaaagcccccaaactcatgattttgaggtcaataagcggccctcaggggtccctgatcgcttctcaggctcaagtctggcaacacggcctcctgacccgtctcgtgggcctccagactgaggatgaggctgattattactgcagctcatattcaggcagcaacgagggtattcgggcgaggaccaagttcgaccgtctaggtcacgacccaggctcgccccgtcggtcactcctcgttcccaccctcccg

SEQ ID NO: 58771 - DNA, 604 bp, Homo sapiens
  misc_feature: GYAE6OF02I48PE.8.42.D09.1.454.CMB.1.raw
  modified_base (222)..(222): a, c, t, g, unknown or other
  misc_feature (222)..(222): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
tcagctcgcgtgtccacgaccggtgctcgatttagacacatacgcagggaaaggggggtcgtcgaggaggcagcgctctcaggacgtcaccaccatggcctggctctgctcctcctcaccctcctcactcaggcacagggtcctgggcccagtctgccctgactcagcctccctccgcgtccggtctcctggacagtcagtcaccatctcctgcactggacnccagcagtgattacaactatatctctgtaccaacaacacccagcaaacgccccaaactcatagattttgagtcaataagcgcctnacgggtcctgatcgcttctcagctcagtctagcaacncgactcctgaccgtctctgggccttccgacgtactgacggactgacggactgacttattacgtgacgtagtctcaattatttacgacggtactaacgacgaaccgtaacgggttacgttaccgggaccggtaacgggaacctaaacggttacgtacccggttacctacgggttaccaaccggtacccaacgggtaaccccgttacccccgtaccggtaccctaacgttccttccggttaccccctaccgtccgtaacccg

SEQ ID NO: 58772 - DNA, 533 bp, Homo sapiens
  misc_feature: GYAE6OF02IYBUQ.8.42.D09.1.454.CMB.1.raw
  modified_base (222)..(222): a, c, t, g, unknown or other
  misc_feature (222)..(222): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaacgcccccaaactcatgtattttgaggtcaataagcggccctcgagggtccctgactcgcttctcaggctccaagtctggcaacgacgcctccgtgaccgtctctggctccagactgaggatgaggctgattattactgcagctcatattcagcagcaacgaggtattcggcggaggacagttcgaccgtcgtaggtcgacgcccgaaggcctaccgcccccgtacggtccaccgttccgttaccgttccccacccgtcccg

SEQ ID NO: 58773 - DNA, 540 bp, Homo sapiens
  misc_feature: GYAE6OF02IVKA0.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagccagcagtgattacaactatatctcctggtaccaacaacacccaggcaaacgcccccaaactcatgattttgaggtcaataagcggccctcacggggtccctgactcgcttctcaggctccaagtctggcaacacggcctcctcgaccgtctctggcctccagactgaggatgaggctgattattactgcagctcattatcagcagcaacgaggtagtcggacggaggacaagttcgaccgtcgtaggtacgacgaccgaaggcctcggtacccccgtcggtcctaccgttccttccgttcccctacccctcccg

SEQ ID NO: 58774 - DNA, 510 bp, Homo sapiens
  misc_feature: GYAE6OF02GSDPC.8.42.D09.1.454.CMB.1.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcagggtccctgatcgcttctcaggctccaagtctggcaacacggcctccctgaccgtctctgggctccagactgaggatgaggctgattattactgcagctcatattcaggcagcaagagggtattcgggacggagggaccaagttcgaccgtctaggtcagccaaggctcgcccctgtcactctcgttcccacctcc

SEQ ID NO: 58775 - DNA, 561 bp, Homo sapiens
  misc_feature: GYAE6OF02IL2JX.8.42.D09.1.454.CMB.1.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctgtaccaacaacacccaggcaaagcccccaaactcatgattttgaggtcaataagcggccctcagggtccctgatcgcttctcaggctccaagtctggcaacacgcctccctgaccgtctctcggctccagactgaggatgaggctgattattaactgcagctcattattcagcagcaacgtagggtattcgggacgggaacgggacctaaaggttcgacccgttccgttacggtccacggaccccaagggcccgtaccgccccccgttacggtcctaccgttccgtacccggtttcccccaccccttcccg

SEQ ID NO: 58776 - DNA, 722 bp, Homo sapiens
  misc_feature: GYAE6OF02FY4XG.8.42.D09.1.454.CMB.1.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatactctcctgtaccaacaaccaccaggacaaccgaccccaaactcatgtattttgaggtacaaataacggccggccctacggacggggtccctagactcgtcttctcgaggcctaccgaagtctggaccaacgaccggtccctcccgtcgtacccgttctccggtcgggcctaccgacgtacgtaggaggagttgggacggtctagtaactttaagttacctggtacctacggtccttactaagtttactttaccggaacgggtacctaaggaaccgtaaaccggtaaggggtttaacgtttccgggggaacggggtaaacgggtaaacccgtaaagggtttaccggtaaccccggttaccgttaacgggtaccgtaaccggaccccggtaaacgggtcccgttaccccggtacccccgttcgggttaccctacccgtttacccgttacccggtttacccccctaccccgtttaccccgg

SEQ ID NO: 58777 - DNA, 550 bp, Homo sapiens
  misc_feature: GYAE6OF02IMFGQ.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcgaggggtccctgatcgcttctcaggctccaagtctggcaacacggcctccctgaccgtctctggcctccagactgagatgaggctgattattactgcagctcattattcaggcagacaacgtagggtagttcggacgggtagggacctaaggttcgaccgtcgtaggtacacggacccgaaggcctccgcccccgttcggtacctaccgttccgtcgtttacccccacccttcccg

SEQ ID NO: 58778 - DNA, 498 bp, Homo sapiens
  misc_feature: GYAE6OF02IL7MU.8.42.D09.1.454.CMB.1.raw
  modified_base (222)..(222): a, c, t, g, unknown or other
  misc_feature (222)..(222): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagctcgcgtgtccacgaccggtgctcgatttagacacatacgcaggggaaagggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcacatctcctgcactgganccagcagtgattacaactatatctcctggtaccaacaacacccaggcaaagcccccaaactcatgattttgagtcaataagcggccctcagggtccctgactcgcttctcaggctccaagtctggcaacacggcctcctgaccgtctctgggctccagactgaggatgaggctgattattacngcagctnatattcagtcagcaacagggtatcgggcgagggacaagttgaccgtcaggtcagccagctcgccctgcactctcgtcccgcctccg

SEQ ID NO: 58779 - DNA, 724 bp, Homo sapiens
  misc_feature: GYAE6OF02IEACZ.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatcctcctgacactggacnccagctagtcgattacaactatatctcctgtaccaacaacaccaggacaaacgccccaaactcatcgtattttagacggttacaaagtaagccggtaccctacgacggggtacccttcgatccggtccttctacgacggtctaccgaagtctcggaccaacgacggtccctacctcgaccgttcgtacgtcggggtactccgtaacgaccgtaggtacggaacgttcgggaacggtcgttacggtaatttaacgttacgtacggtaccgtaacgtcgttacctaacgttacgtttaccgaacgggttaccaacggtaaccgtaaaccggtaaagggggttacctttaaccggggacgggtaaaccggggtaaccgtaaacggtttcggaacccggttaccgtaacgggttaccgaaccggtacccgaaggtcccgttaccggtaccccccgtagggtaccctacgttcccgtaccgttacccccgtaccccttaccccg

SEQ ID NO: 58780 - DNA, 576 bp, Homo sapiens
  misc_feature: GYAE6OF02JX4C5.8.42.D09.1.454.CMB.1.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagccccaaactcatgattttgaggtcaataagcggccctcagggtccctgatcgcttctcaggctccaagtctggcaacacggccctcccgtgacccgtctccgtgggcctccgacgactgacggatggaggtctgtattattactgcagctcatattcaggtcagacaacgtagggtattcgggcgaacgggacctaacggttcgacccgttacgtacggttccgaacggtacccgaagggtcctaccggcccccgttcggtacccaccgttccgttcccgttaccccgtaccccgttacccg

SEQ ID NO: 58781 - DNA, 511 bp, Homo sapiens
  misc_feature: GYAE6OF02GADHW.8.42.D09.1.454.CMB.1.raw
  modified_base (227)..(227): a, c, t, g, unknown or other
  misc_feature (227)..(227): n is a, c, g, or t
  modified_base (403)..(403): a, c, t, g, unknown or other
  misc_feature (403)..(403): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacaccaggcaaagcccccaaactcatgattttgaggtcaataagcggcctcagggtcctgatcgcttctcaggctccaagtctggcaacacggcctcctgaccgtctctggctccagctgagatgagctgattattacngcagctcatattcaggcagacaacgagggttacttcgggcggagggaccaagttgaccgtacgtaggtcacgcccaggctcgccccgtcggtacacgtctcgtacccc

SEQ ID NO: 58782 - DNA, 565 bp, Homo sapiens
  misc_feature: GYAE6OF02JJCCL.8.42.D09.1.454.CMB.1.raw
  modified_base (224)..(224): a, c, t, g, unknown or other
  misc_feature (224)..(224): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
tcagctcgcgtgtccacgaccggtgctcgatttagacacatacgcagggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacacacccaggcaaagcccccaaactcatgattttgagtcaataagcggccctcaggggtccctgatcgcttctcaggctccaagtctggcaacncgcctcctgaccgtcnctggctccagactgagntgagctgattatactgcagctacatacttcgaggtcagaccaaacgtggggttacttccgggacggaacgggaaccctaaggttcgaacccgttccgtaaggtccgaacggcccgaaagggtccctccggccccccttagggtccctaccgttccttaccgttcccccacccgttcccg

SEQ ID NO: 58783 - DNA, 534 bp, Homo sapiens
  misc_feature: GYAE6OF02F2YYZ.8.42.D09.1.454.CMB.1.raw
  modified_base (405)..(405): a, c, t, g, unknown or other
  misc_feature (405)..(405): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcgcctcagggtccctgatcgcttctcaggctccaagtctggcaacacggcctcctgaccgtctctgggctccagctgagatgagctgattattacngcagctcatattcaggcagcaacgagggttacttcggacggaagggaccaaggttcgacccgtaccgtaggtaccaggccccaaggcctaccggtcccccttacggtccaccgttcgtccgttaccccc

SEQ ID NO: 58784 - DNA, 573 bp, Homo sapiens
  misc_feature: GYAE6OF02IKAAU.8.42.D09.1.454.CMB.1.raw
  modified_base (223)..(223): a, c, t, g, unknown or other
  misc_feature (223)..(223): n is a, c, g, or t
  modified_base (334)..(334): a, c, t, g, unknown or other
  misc_feature (334)..(334): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaacgcccccaaactcatgattttgaggttcaataagcggccctcagggtccctgatcgcttcncaggctccaagtctggacaacacggcctccctgaccgtctcgtcgggctcccgagacgtgaggatggaggtctgtattattactgtcagtctcatattcaggcagacaacgtagggttaagttcgggacggtacgggacgtaacgttcgacccgttaccgtaggtaccgaacggacccgaaggtccgtccgacccccgttcggtacctaccgttccgtcgttacccccgcccttacccg

SEQ ID NO: 58785 - DNA, 543 bp, Homo sapiens
  misc_feature: GYAE6OF02HZ3GQ.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaacgcccccaaactcatgattttgaggtcaataagcggccctcgagggtccctgactcgcttctcaggctccaagtctggcaacacggcctcctcgaccgtctcgtcgggcctccgagactggacggtatggaggtctagattacttactgcagctacattatcaggcagacaacgagggtactcggacggagggactaagttcgaccgtctacggtcacgcccaggcctccgcccccgtggtcctacctcgtccgttccccaccctcccg

SEQ ID NO: 58786 - DNA, 648 bp, Homo sapiens
  misc_feature: GYAE6OF02HC1LQ.8.42.D09.1.454.CMB.1.raw
  modified_base (462)..(462): a, c, t, g, unknown or other
  misc_feature (462)..(462): n is a, c, g, or t
tcagctcgcgtgtccacgaccggtgctcgatttagacacatacgcagggaaggggggtcctcaggaggccagcgcgtctcaggacggtctaccaacctatggccctgggcctctgctccgtcctcaccctcctcacctcacggcacagggtcctgggtcccagtcgtgccctgactcagcctccctccgcgtccgggtctcctggacaggtcagtcaccgagtcgtaccgtcggctactggagccgagcagtgattacactatattcctccttggtaccaacaactaccaggcaaacgccccgaaactcactgacttttagacggtacaagtaacgcggaccctcgacgggtcccgtagactcgtcttctccaggctaccaagtcgtagcaacgacggcctccctacgacccgtctccgtggcctccgacgactagagactcggacgactgattacgttacngcctacgcctacattacgttcgaacggcacgacaacgtacgggttacgtccgggacgggaaccgggaccgtaaaggttcgtaccggtacgttacggtaccgaacggacccgtaaaggtccgtaaccggcccccggttcgggtaccgtaccgttcggttccggttttccccgcccgtttaccccggg

SEQ ID NO: 58787 - DNA, 551 bp, Homo sapiens
  misc_feature: GYAE6OF02IRWOX.8.42.D09.1.454.CMB.1.raw
  modified_base (223)..(223): a, c, t, g, unknown or other
  misc_feature (223)..(223): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctcctgtaccaacaacaccaggcaaacgcccccaactcatgtattttgagtacaatagccggcctcgacgggtcctgactcgcttctcacgctcagtctgacacncgcctcctgaccgtctcgtggcctcgngactgagntgagtntgtattatacngcagtctacatattcgagcagacaacgtaggtacgttcggacgggaagggtacctaggttacgaccgtacgtaacggtcgaacggacccgaaggtccctccggtacccccgtcggtacccaccgttccgtccgttacccctaccgtcccg

SEQ ID NO: 58788 - DNA, 553 bp, Homo sapiens
  misc_feature: GYAE6OF02I1X2P.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaacgcccccaaactcatgtattttgaggtcaataagcggccctcgacggggtccctgatcgcttctcaggctccaagtctggcaacgcggcctccctcgaccgtctctcggctccagactgaggatggagctgattatactgcagtctacattatcagcagacaacgaggtacttcgggacggaggacctaagttcgaccgtcgtaggtccgacggacccgaaggtcctccgtcccccgttcggtacctaccgtccgttccgttcccccgccccttacccg

SEQ ID NO: 58789 - DNA, 528 bp, Homo sapiens
  misc_feature: GYAE6OF02JCW1Y.8.42.D09.1.454.CMB.1.raw
  modified_base (336)..(336): a, c, t, g, unknown or other
  misc_feature (336)..(336): n is a, c, g, or t
  modified_base (521)..(521): a, c, t, g, unknown or other
  misc_feature (521)..(521): n is a, c, g, or t
tcagctcgcgtgtccacgaccggtgctcgatttagacacatacgcagggaaaggggggggtctcaggaggcagcgctctcaggacgtcaccaccatggcctggtctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaactcatgatttttgaggtcaataagcggccctcgagggtccctgatcgcttcncagctccaagtctgcaacacggcctcctgacccgtctcgtggcctccgagtactgaggatggaggctgtattattactgcagtctcattattcaggcagcaacgagggtattcgggcggaggacctaagttcgaccgtctagtcgacgccgaaggcctcgcccctggtccacctctcgttccccncctcccg

SEQ ID NO: 58790 - DNA, 624 bp, Homo sapiens
  misc_feature: GYAE6OF02HOXGG.8.42.D09.1.454.CMB.1.raw
  modified_base (244)..(244): a, c, t, g, unknown or other
  misc_feature (244)..(244): n is a, c, g, or t
  modified_base (332)..(332): a, c, t, g, unknown or other
  misc_feature (332)..(332): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacgccagcagtgattacaactntatctcctgtaccaacaacaccagacaaacgccccaaactcatgtattttgagtacaataagcgcctcgacgggtcctgatcgcttcncagctacagtctgcaacacggcctccgtcgacctctcgtcggcctccgagtactgaaggagtggacggtctagtaatttacttacgtgactacgtctactaattacgttacgaaggtccaacggacctaaacgggtagggttacgttccggggacgggtaacgggacctaaagggttccgtaaccggttccgtaacgggtaccgaacggaccccgaacggtcccgttacccgacccccggttcggtaccctaccgtttcccgttacccgttacccccctacccgttaccccg

SEQ ID NO: 58791 - DNA, 515 bp, Homo sapiens
  misc_feature: GYAE6OF02FMLXH.8.42.D09.1.454.CMB.1.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggccctccctgacccgtctctgggctccagactgaggatgaggctgattattactgcagctcatattcaggcagcaagaggtattcggcggaggaccaagttgaccgtctaggtcagccaaggcctgccccctggtccactctcgttccccgcctcccg

SEQ ID NO: 58792 - DNA, 746 bp, Homo sapiens
  misc_feature: GYAE6OF02JOJTZ.8.42.D09.1.454.CMB.1.raw
  modified_base (308)..(308): a, c, t, g, unknown or other
  misc_feature (308)..(308): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacaccagacaacgaccccaaactcatgtattttgagtcaataagcgccncgacgggtccctgactcgcttctcgagctaccaagtctggacaaccgacggccctcctacgaccctctaccgtcgggccttaccgaggtaccgtggaacggtacgtacggaacggtcgttaggtaatttaacgttacgtacggtacgtaacgtccttacgtaacttaacgtttaccgaagggttaccgaacggtaacccgtaaacgggtaacgggggttaacgttccgggggtaaccggggtaaacgggtaacccggttaaacgggtttacccggtaaccccgggtttaccggttaccgggtacccggtaacccgggtaaccccggaaacggggttccccggttacccggtacccccccggtttaccgggtttaccccgtaacccggtttcccggtttaccccgggtttaccccccgtacccccggtttaccccccgg

SEQ ID NO: 58793 - DNA, 865 bp, Homo sapiens
  misc_feature: GYAE6OF02HXYC8.8.42.D09.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtcgtcgaggaggcgagcgctctcaggacgtcaccaccatggcctgggctctgctcctcctcaccctcctcactcagggcacaggtcctgggcccagtctgccctgactcagcctccctcgcgtccgggtctcctggacngtcagtcacatctctgcactggacnccagcagtgattaacaactatatcctctaggtaaccaacaacacccgaagaccaaaacgcccccaaaactcactaagttattttacgaggtaccaaaagtaacgccggacccttacgaggggtaccccttagaacgtcgtaccgtttctaccgtacggacttacccgaaacggttcgtcgggaaccaaaccgtacccgggtcccctttaccccgtacggtaacccgttacgttcccgttaccggggtccctaccccgttaaggaccgttaccggtaagggtaaacgttccccggggaaggttaccgttagtaaacgtttaacttttaaccggtaggaaccgttaacggtcctttacctaaagttttaactttccggaaacgggtacgaaccgttaaacgaaaccggtaaacgggggtttacgttaacccggggggtacggaaacggggggtaaacccctaaaaggggttttcccgggaaccccggtttaacccggttacgggtttaaaccggtaacccggggacccccttaaaaggggtcccccggtttaacccccggccccccgtttaaccgggggttcctaaacccccgttttccggggtacccgtttttccccccccgggaccccctttttaaccccgg

SEQ ID NO: 58794 - DNA, 573 bp, Homo sapiens
  misc_feature: GYAE6OF02GDKMP.8.42.D09.1.454.CMB.1.raw
  modified_base (367)..(367): a, c, t, g, unknown or other
  misc_feature (367)..(367): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgactcgcttctcaggctccaagtctggcaacacggcctcccngaccgtctcgtgggcctccagactgaggatgaggctgattattactgcagctcatatcaggcagacaacgagggtattcgggcggaacgggaccaaaggttcgaacccggttcctacgggtacgacggacccaaacgggtcctccggccccccgttacgggtacctaaccgttcccgtttccgtttacccccaccccgttaccccg

SEQ ID NO: 58795 - DNA, 510 bp, Homo sapiens
  misc_feature: GYAE6OF02J0BDJ.8.42.D09.1.454.CMB.1.raw
  modified_base (223)..(223): a, c, t, g, unknown or other
  misc_feature (223)..(223): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctgtaccaacaacaccaggacaaagcccccaaactcatgatttttgaggtcaataagcgccctcagggtccctgatcgcttctcagctcaagtctgcacacgctcctgaccgtctcgtggctccagactgaggatgagctgattatactgcagctanatnttcagtcagcaacgaggtatcggacggaggactaagtcgaccgtcgtaggtcgacgtccaaggtcctcgccccgtcgtccactcgtccgttcccgccctccg

SEQ ID NO: 58796 - DNA, 576 bp, Homo sapiens
  misc_feature: GYAE6OF02GGEQJ.8.42.D09.1.454.CMB.1.raw
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacaccaggcaaacgccccaaactcatgattttgaggtcaataagcgcctcagggtccctgatcgcttcncagctccaagtctgcaacncggcctccctgacccgtctccgtgggccttccgagtacctgaacggattggaggtctagtactttaagttaactgtacagcttacgattattcgaggctagacacgtagggttatccgggacggtaacgggacctaagttaggacccgtcgtacggtccgacggacccacggtccgtcggaccccccgttacggtacctaccgttcgtccgttccccgacccttcccg

SEQ ID NO: 58797 - DNA, 574 bp, Homo sapiens
  misc_feature: GYAE6OF02GR9RI.8.42.D09.1.454.CMB.1.raw
  modified_base (420)..(420): a, c, t, g, unknown or other
  misc_feature (420)..(420): n is a, c, g, or t
  modified_base (459)..(459): a, c, t, g, unknown or other
  misc_feature (459)..(459): n is a, c, g, or t
tcagctcgcgtgtccacgaccggtgctcgatttagacacatacgcagggaaaggggtgggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatgggagggggcttgatccgaggccggggggtcctgagactctcctgtgcagcctctggcttcacatcagtagagactacatgagcgtcgggcccgccgaggcctccgaggggaacggggctagggagtcggggtctcgtagtttatttagtcgacgtagtgggtggcacacactacgcagacctccgtagaacgggcagtattccgaccgtcnccgagagaaccaattccaaagacagttggtatatcttanaaatgaacagactaacgagccgaggacacgggtcctattacgttacgtggtacggacgaagaccgtagttaggaccttacgggtgaccggtcccggtagggggaccctaacgggg

SEQ ID NO: 58798 - DNA, 590 bp, Homo sapiens
  misc_feature: GYAE6OF02GYWJ1.8.42.D09.1.454.CMB.1.raw
  modified_base (243)..(243): a, c, t, g, unknown or other
  misc_feature (243)..(243): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactntatctcctggtaccaacaacacccaggcaaagcccccaaactcatgattttgaggtcaataagcggccctcgacgggtccctgactcgcttctcaggctcaagtctggccaacacggcctcccgtgacccgtctcgtcgggtcctcccgagtactggaggatcggaggtctgtattattactgacagctacatattcaggcagaccaacgagggttacgttcgggacggacgggaccctaaggttcgaccggttccgtacggtccgacggacccgaaggccgtccggtccccccggttcggttcccgtaccgttcccgttacccggttccccgaccccgttccccgg

SEQ ID NO: 58799 - DNA, 679 bp, Homo sapiens
  misc_feature: GYAE6OF02IOWMD.8.42.D09.1.454.CMB.1.raw
  modified_base (196)..(196): a, c, t, g, unknown or other
  misc_feature (196)..(196): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcaggcacagggtcctgggcccagtctgccctgactcagccctcctccgcgtccgggtctcctggacngtcagtcaccatctcctgcactggagccagcagtgattacaactatatctcctggtaccaacaacacccaggcaaaagccccaaactcatgtattttgagtcaaataagcgccctnacgggtccctgatcgcttctnacggctccgtaatcgtggacaaccgtacggcctacccttcgaacccttcgtaccgttggggcctaccgacgtaccgttacggaacggtaacgttggaacgggtccgttaggtaacgttttaacgttaaccgtggttaccgaacggtccttacgtaaccttaagtttaccgagggcctaaagcctaaacgtaacggggtaacttacggggaccgggaagggttaacccgaaaggttcgtaacccgtaccgttaaggtccgaacggaaccctaagggacctacccgggtaccccctccggggttaccaacccgtttgacccggttttacccccgcccgtttaaccccg

SEQ ID NO: 58800 - DNA, 550 bp, Homo sapiens
  misc_feature: GYAE6OF02INLPC.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacaccaggcaaacgccccaaactcatgtattttgaggtcaataagcgcctcgacgggtccctgactcgcttctcgacggctccaagtctcggacaacgaccggcctccgtcgacccgtctcgtcgggcctccgagtactgacggatgaggtctagtattacttactgcagtctcattatcgagcagacaacgtaggtactcggcggacggacaagtcgaccgtcgtacgtcgacgaccgaggtcctccgccccgtcggtactaccgttcgtccgttccccaccctcccg

SEQ ID NO: 58801 - DNA, 540 bp, Homo sapiens
  misc_feature: GYAE6OF02F6949.8.42.D09.1.454.CMB.1.raw
  modified_base (223)..(223): a, c, t, g, unknown or other
  misc_feature (223)..(223): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactgganccagcagtgattacaactatatctcctggtaccaacaacaccagacaaacgcccccaaactcatgattttgaggtcaatagcgcctcgagggtccctgatcgcttctcaggctcaagtctggcacacggcctcctgaccgtctctggcctccgagacctgaggtatggaggtctgattattactgctagctcatactcaggcagacaacgaggttacgtcgggacggacggacgtaacgttgaccgttctacggtcgaacgtacccgaaggtcctcgccccgtcggtccaccgttcctccgttccccacccgtcccg

SEQ ID NO: 58802 - DNA, 574 bp, Homo sapiens
  misc_feature: GYAE6OF02FX22J.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacaccaggcaaacgcccccaaactcatgatttttgaggtcaataagcggccctcgacggggtccctgatcgcttctcaggctccaagtctgcacacgcctcctgaccgtctcgtggcctccagacgtgaggatggaggctgtattattactgcagtctcattacttcaggcacgacaacgtagggttacgttcgggacgggaaggaccgtaaggttcgacccgttaccgtaggtccgacggacccgtaacggcccgttcccggccccgttcggtacctaccgttccgtcccgttacccctaccccgttccccg

SEQ ID NO: 58803 - DNA, 565 bp, Homo sapiens
  misc_feature: GYAE6OF02FX7W6.8.42.D09.1.454.CMB.1.raw
  modified_base (479)..(479): a, c, t, g, unknown or other
  misc_feature (479)..(479): n is a, c, g, or t
  modified_base (559)..(559): a, c, t, g, unknown or other
  misc_feature (559)..(559): n is a, c, g, or t
tcagctcgcgtgtccacgaccggtgctcgatttagacacatacgcagggaaagggggggtctcaggaggcagcgctctcaggacgtcaccaccatggcctgggctctgctccctcctcaccctcctcactcagggcacgagggtcctgggcccagtctcgccctgactcacgccctccctccgcggtccgggtctcctggacagtcagtcaccatctcctgcacgtggacgccagcagtgattacaactatactctctggtaccaacaacaccagacaaacgccccaaactcatgtattttagagtacaagtaagccggccctacgacgggtccctgactcgcttctcgaggcctcctaagtctcggaccaaccgacggccctccctagtacccgttctccgtgggcctaccgagacgtgaggatggacggctagtattagttactgctagctatatatcaggcagacaacgtagggtntcgggacggacggtactaagttcgaccgttcgagtcgacgcccgaggctccgcccctcggtccacttccgtcgttacccncctccg

SEQ ID NO: 58804 - DNA, 626 bp, Homo sapiens
  misc_feature: GYAE6OF02HS8A1.8.42.D09.1.454.CMB.1.raw
  modified_base (223)..(223): a, c, t, g, unknown or other
  misc_feature (223)..(223): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctctgcactgganccagcagtgattacaactatatctcctgtaccaacaacaccaggacaacgccccaaactcatgtattttgaggtcaataacgccggccctcgacggggtccctgactcgtcttcctcgacggcctaccaagtcgtacggcaaccgacggccctcccgtcgacccgttctcgtcggcctccgagtactggaggngtggacggtntgtaattacttacgtgctacgtctactattacttacaagggtcaacgacgaaacgtaggggttacgtaccgggacgggtaacgggaacctaagggttccgacccgttaccgtacggtaccgaacggacccgtaaggtcccgtaccggtcccccgttaggtaccctaccgttcccggtcgtttcccccgccccttacccgg

SEQ ID NO: 58805 - DNA, 610 bp, Homo sapiens
  misc_feature: GYAE6OF02H5Q69.8.42.D09.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctcgccctgactcagcctccctcgcgtccggtctccgtggacagtcagtcaccattcctcctgcacgtggacnccagcagtgattacaactntatctcctagtaccaacaacaccagacaaacgccccaaatcatgtattttgacgtacaataagccgccgtacgacgggtcccgtagactcgtccttctaccgacggacctacctaacgtcgtcgtaccgaacgtacggtccgtccctacgtacccgtctcgtcggtacctccgacgtacgtcgtaggagtagacgtcgtagtattaacgttactagtcacgtcacttacttactacgagcgagacgtacgaggtacgtcggacggaaggaccgaagttcggtaccgtacgtacggtacgacgtaccgaaccggctcccgtcccgtccgtccgaccttccggtaccttccccgccgttacccg

SEQ ID NO: 58806 - DNA, 529 bp, Homo sapiens
  misc_feature: GYAE6OF02GUYAC.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaactcatgatttttgaggtcaataagcggccctcgacggggtccctgactcgcttctcaggctccaagtctggcaacacggcctcctgaccgtctcgtcgggctccgagactgaggatgaggctgtattatactgacagctcatatcagcagcaacgaggtactcggacggaggacctagtcgaccgtacgtaggtcacgccaggctccgccccgtcggtctaccgtccgtcgttccccgcctcccg

SEQ ID NO: 58807 - DNA, 568 bp, Homo sapiens
  misc_feature: GYAE6OF02GAVJR.8.42.D09.1.454.CMB.1.raw
  modified_base (351)..(351): a, c, t, g, unknown or other
  misc_feature (351)..(351): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggacaaagccccaaactcatgattttgaggtcaataagcgcctcacgggtcctgatcgcttctcagctccaagtctggcaacncggcctcctcgaccgtctcgtggctccagactgagatggagctgattatacngcagctnatattcaggcagacaacgtagggttacttcgggacgggaacggaacgtaacggtttcgaccgttccgtaagggtaccgaacggtacccgaagggtccctaccggtccccccgttcggtcctaaccgttccgttcccgttacccccgaccccttccccg

SEQ ID NO: 58808 - DNA, 618 bp, Homo sapiens
  misc_feature: GYAE6OF02IGU6F.8.42.D09.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (420)..(420): a, c, t, g, unknown or other
  misc_feature (420)..(420): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacngtcagtcaccatcctcctgcactggacnccagcagtgattaccaactatatcctcctgtaccaaacaacaccaggacaaacnccccaaactcatgtattttgagtacaatagccgcctgacgggtccctgactcgtcttctcgacgcctccaagtctcggaccaaccgaccgcctccctcgtacccgtctcgtcggcctccgagacgtggaggtatggacgtnttagtatttacgttactgacagtcctgtaattatcgaggcagactaacgtagggttacgttacgggacgggaacggtaaccgtaaggttcgacccggttaccgtacgggtccgaacggtaaccccggtaggtcccgtacccgtcccccggtcggttaccaccgttcccgttacccggttcccccgtccccgttacccg

SEQ ID NO: 58809 - DNA, 601 bp, Homo sapiens
  misc_feature: GYAE6OF02GQAKW.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaactcatgtatttttgaggtcaataagcggccctcgagggtccctgactcgcttctcaggctcaagtctggacaacgcggcctccctgacccgtctcgtgggcctccagtacctgaggatggaggtctagtattacttacgtcgctacgctactattattcgagacagacaaggtacggttagttccggacgggaacggtaaccgtaaggttccgacccggttaccgtaaggtaccgaaccgggtacccgtaacgggtccctacccggtcccccggttaccggtccctaacgttcccgttacccgttacccccccg

SEQ ID NO: 58810 - DNA, 556 bp, Homo sapiens
  misc_feature: GYAE6OF02H3OYC.8.42.D09.1.454.CMB.1.raw
  modified_base (226)..(226): a, c, t, g, unknown or other
  misc_feature (226)..(226): n is a, c, g, or t
  modified_base (426)..(426): a, c, t, g, unknown or other
  misc_feature (426)..(426): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgganccagcagtgattacaatatatctctggtaccaacaacaccaggacaaacgccccaaactcatcgtatttttgaggtcaataagcggccctcgacgggtccctgactcgtcttctcacgctacaagtctgacaacacggcctccctgaccgtctcgtcggctccagctgagtatgaggctgtatttactactgctagctanatattcgacgacagacaacgtagggttactcgggacggaacgggaaccgtaggttacgtaccgtcgtacggtaccacgacccgtaaggccttaccggccccgttcgtaccgacttccgtccgttcccccg

SEQ ID NO: 58811 - DNA, 766 bp, Homo sapiens
  misc_feature: GYAE6OF02HB4EZ.8.42.D09.1.454.CMB.1.raw
tcagctcgcgtgtccacgaccggtgctcgatttagacacatacgcacgggaaagggggtgggagaggagcccagtcgacctgggagttacccgaggtggtagtcccagttccggtgatctagctacctcgtaacacagaggacgtccacccagtggtacgttcctgggactagggtcttggggttttccttgttcgcaattttcaaaacggtgtccacgttgtgtaggtgctacgcgtggtaggagaacgtcgggtaggggtccttggactccggacggccggggggtccctaggacgtacgttcgtccgtgtacgtcaccgccgttcgtggccttacgaccctagtccgaaggttacgaggtaccttaccagtacgtacgcggtcgggaccccgaccgtacggcctaccgggaacgggtacgggtcgtacggtacggtacggtccgtacgttagtttacgtttacgcggtacggtaggttcggttacgggactaaccgtaccgttactaccgtactaaccgtaccgtcggttaacggaacggcgtaacggtaccttacgacccgttcgtaccgaagaacgtaacttaactaccgtaaagttaactgttcggtattactaccttagtaaatacgaactacgtaacgtaacgtcgtaccggaaacggtaccctaggtaccgttaagttacgttacgtggtaccgaacggtagtaacgtgtacgtactacgggtcctacggtacccggttaggaccctttaaccgggg

SEQ ID NO: 58812 - DNA, 968 bp, Homo sapiens
  misc_feature: GYAE6OF02IKY5F.8.42.D09.1.454.CMB.1.raw
  modified_base (243)..(243): a, c, t, g, unknown or other
  misc_feature (243)..(243): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctccaccctcctcactcgagggcacgacgggtcctcgggcccagtctcgccctgactcacgccctccctccgccggtccgggtctccgtggacagtcacgtccaaccatcctccgtgcacgtggacnccagcagtgtacttaacaatatactcctccgtacgtaaccaaaccaaaccacccgagaccaaaccgaccccaaactcatgttattttgagtacaagtaacggccgaccctcggacggggttccctagacgttcgtccttccgtacgaccgggtacctaccgtaaacgttccgtacgggtaacccaaaccggtaccccggtccccttaccccggtaccggtaacccgttcccgtttacccgggtaccgggggtaccccttaccccgtaaacgggtaccgtacggggtaaacgggtacgttaacgggggtaaccggggtaccggttaacgggtttaaacttttaaacggttttacccggttacggtacccggttaaccggttacccgtttaaaccgttaaaccgttttaacgtttaaccgggtaaccgggtacgtaaacccgggtaaccggtaaaaccggggtacggggttttaaaccgggttaccgggggaaacccgggggttaaacgggggtaaacccggttaaaccgggtttacccgggtaaaccccggttaccgggttaaccggggttacccgtaaaccccggggtaacccccgggtaaaaccgggttcccggttaaccccccgggttacccccccgggtttacccgggttaacccgttacccccggttttcccggttttacccccggttttcccccccggttaaccccccgtttcccccggg

SEQ ID NO: 58813 - DNA, 907 bp, Homo sapiens
  misc_feature: GYAE6OF02GIZDT.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacgccagcagtgattacaactatatctcctggtaccaacaacaccagacaaacgaccccaaactcatgtattttgaggtacaataacgccggcctcgacgggtccctgactcgtccttcgtcgacggtcctaccgtaaacgttcgtacggaccgtaaaccgtacccggtaccccgtttaccccgttacggtaaccccgtttcccgttacccggttccggggtacccttaccccggtaacggtaaccgttacgggtaacgggtaagttacggggtaacgggttacccgttacggtttaaacgtttttaacgttttaacccgttacggtacccgttaacggttccctttaacgtaaactttaacggttttaccgaaccgggtaccgtaaaccggtacccgtaaaacccggggttaacggggggtttaaccggttttaaccgggggggtaaacccggggtaaccgggggttaaaaccccgtttaaaacggggtttaccccggtaaccccggggttttacccggttaaaccggggtttacccgaaacccggggttaaccccggttaaaaccggggttccccgtttacccccgggtacccccccggtttacccgggtttaacccgttaccccggttttaacccggtttccccccggttttacccccccgggtcccccttttacccccggg

SEQ ID NO: 58814 - DNA, 572 bp, Homo sapiens
  misc_feature: GYAE6OF02F5G5C.8.42.D09.1.454.CMB.1.raw
  modified_base (336)..(336): a, c, t, g, unknown or other
  misc_feature (336)..(336): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagccagcagtgattacaactatactctcctgtaccaacaacaccaggacaaacgccccaaatcatgtattttgaggtacaataagccgccctcgacgggtccctgactcgcttcncagctcaagtctgcaacgacgcctcctgaccgtctcgtggcctccgagacctggacggtatggaacggtctagtactttacgttactgactacgtctctattactcgagcacgacaacgtagggtacgttcgggacggtacggaccgtaagttcgaccgttcgtacggtacacggaccgaacggtccgtaccgtccccgtcgtccgtaccgtccgttccgttccccgcccttcccg

SEQ ID NO: 58815 - DNA, 552 bp, Homo sapiens
  misc_feature: GYAE6OF02FHKU9.8.42.D09.1.454.CMB.1.raw
  modified_base (436)..(436): a, c, t, g, unknown or other
  misc_feature (436)..(436): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagccagcagtgattacaactatatctcctggtaccaacaacacccaggcaaagcccccaaactcatgatttttgaggtcaataagcggccctcgaggggtccctgatcgcttctcaggctccaagtctggacaacgacggccctccctcgacccgttctccgtggggcctccagacctgacggatggaggctgatttatactgcagctacatnttcgaggcagcaacgagggttacgtacggcgggaaggaccaaggttcgaccgtacgtaggtcgacggcccgaacggctcgcccccgtggtccacgtcgtcgttccccgccctcccg

SEQ ID NO: 58816 - DNA, 645 bp, Homo sapiens
  misc_feature: GYAE6OF02GFYWG.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatcctcctggtaccaacaacacccaggacaaacgccccaaactcatgtattttgaggtacaataacgccggccctcgacggggtccctagatcgcttctcaggcctccgaagtcgtggaccaacgacggccctccgtacgacccgtctccgtcgggtcctaccgacgtactggaacggtataggaggtctaggtaactttattaccgtgacctagtcctactaattacttcgacggacacgacaaacgtagggttacgttccggggacgggaacgggtaccgtaaggttaccggacccgttaccgtagggtaccgtaacggaccccggtaaggtcccgttaccggtacccccgttacggtcctacccgttccgttcccggttcccccgtcccttaccccgg

SEQ ID NO: 58817 - DNA, 538 bp, Homo sapiens
  misc_feature: GYAE6OF02IUK4Z.8.42.D09.1.454.CMB.1.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
tcagctcgcgtgtccacgaccggtgctcgatttagacacatacgcagggaaaggggggggtctcaggaggcagcgctctcaggacgtcaccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacacgccaccccggnagacgacccccaaactcatcatttangatgtcactgactccgccctcgtagggttcaatcgctttctcgtcgctactaagtctcgacaacgcggccctccgtagaccctatcctcgtcgggtcctccgaggctaggaacggacgaggtctactatttattattcgactagttcagtactacgacagcagctatctgtgtcgtcgggcggtacggactagttcgaccgttactagtccacgacccgtaggcctcccg

SEQ ID NO: 58818 - DNA, 551 bp, Homo sapiens
  misc_feature: GYAE6OF02IU322.8.42.D09.1.454.CMB.1.raw
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatcctcctgcactggagccagcagtgacttacaactatatcctcctgtaccaacaacacccaggacaaacgcccccaaactcatgtatttttgaggtcaaataagcggccctcgacggggtccctgactcgcttctcaggctaccaagtctggcaacacggcctcctgaccgtctcgnggcctcagactgagntgagtctgattatacngcagctacattattcgagtcgacgactaacgtaggttacgtcgggacgggacggactaaggttcgaccgtctaggtccgaacggcccaaggtccgtccgccccgtggtcctccgtcgtccgttcccacctcccg

SEQ ID NO: 58819 - DNA, 593 bp, Homo sapiens
  misc_feature: GYAE6OF02GKBOI.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagccagcagtgattacaactatatctcctgtaccaacaacaccagacaaacgcccccaaatcatgtattttgagtacaataagccggcctcgacgggtccctgtactccgtcttctcacgcctaccgaagtcgtcggacaaccgaccggtccctcccgtcgtacccgtctcgtcggcctccgacgtacgtgaggtagtggtaggcttagtactttacttaccgtgcagtcctactattacttcgaggcacgacaacgtaggtacgttacggcggaacggtaccaaggttcgaccgttacgtaggtacgacgaccgacggccttccgaccccgtcgtacctaccgttccgtccgttacccctcccgtcccg

SEQ ID NO: 58820 - DNA, 579 bp, Homo sapiens
  misc_feature: GYAE6OF02HBJP1.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaaccacccaggcaaacgccccccaaactcatgtatttttgaggtacaataagcggccctcgacgggtccctgatcgcttctcaggctccaagtctggcaacacggcctcccgtgaccgtctcgtcgggcctccgacgactggaggtagtgaggtctagtattagttactcgacagtctctattactcgacggcagacaacgtagggttacgttcgggacggaacgggaccgtaaggttcgaccgtaccgtacggtaccacggccctaaggcctaccggtcccccgtcggtacccaccgttccgttcccgtcccccg

SEQ ID NO: 58821 - DNA, 568 bp, Homo sapiens
  misc_feature: GYAE6OF02IPZCK.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagcaaacgccccaaactcatgtattttgagtcaataagcgcctcgacgggtcctgatcgcttctcaggctaccaagtctggaccaacgaccggcctcctgaccgtctcgtggctcgagactgagatgaggctagattatactgcagtctacattatcaggcacgacaacgtaggtactcgggacggacgggaacctaaggttacgaccgttcgtaaggtccgaacggaccccgaaggtccctaccggccccccgttacggtacctaaccgttcccgtaccggtttacccccgcccttaccccgg

SEQ ID NO: 58822 - DNA, 648 bp, Homo sapiens
  misc_feature: GYAE6OF02IFXYQ.8.42.D09.1.454.CMB.1.raw
  modified_base (174)..(174): a, c, t, g, unknown or other
  misc_feature (174)..(174): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
tcagctcgcgtgtccacgaccggtgctcgatttagacacatacgcaggggaaaggggggggtctcaggaggcagcgctctcaggacgtcaccaccatggcctggctctgctcctcctccaccctctcactcagggcacaggtcctgggcccagtctgccctgactcagcctccnccgccgtccgggtctcctggacagtcagtacaccatcctcctgcacgtggacgccagcagtgacttacaactatactctctggtaaccaacacaccaggacaaacgaccccaaatcatgtattttcgacgtacataacgccgcctcgaacgggtcctagactcgtctctcgacggtcctaccaagtcgtacggacctaacgcccggaccctccgtcgtaccgtctacgtcggtcctaccgacgcgtacgacggtanaggtacgtntagtaattacgtttcngaccagtcttacaacgttatacgacggacgaacgaacctagggtacggttaacggtaccggggacggggtaacggaaccgtaacggttacgggaccgttacgtacgggtacgaaccggtacccgacggtaccctcccggtaccccggtcgttaccgacccgttccggttaacgtccccccgttacctaccccg

SEQ ID NO: 58823 - DNA, 730 bp, Homo sapiens
  misc_feature: GYAE6OF02IAO9P.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcttgggcccagtctgccctgactcagcctccctccgcgtccgggtctcctggacagtcagtcaaccatctcctgcatgganccagcagtgaattacaactagtaatcctcctaggtaccaaacaacaccaggacaaacgccccaaaactcatcgtattttagacggtacaaagtaacgcgcctcgacggggtccctagatcgcttactcgaggctaccaacgtctacggacaacgaaccggtcctacccgtcgaccgtactccgtacgggccttaccgaacgtacgtaggtacgggaattcgggaacggccgttaagtaacgtttaagttaccgtgaccgtaacgtctactaagttagttacgaacggtcaaacgactaaacggtaacgggttacggttaccgggacgggtaacggggtaaacctaaggtttaccggaacccgttacccgttaacggggtacccgaaaccggtaaccccgtaacggggtaccccgttaccccggtacccccccgtttaacgggtaccctaaacccgtttcccggtttaacccggttttacccccccctaccccgttttaacccccgg

SEQ ID NO: 58824 - DNA, 556 bp, Homo sapiens
  misc_feature: GYAE6OF02F57ZL.8.42.D09.1.454.CMB.1.raw
tcagctcgcgtgtccacgaccggtgctcgatttagacacatacgcagggaaaggggtgggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatggagggggcttgatccgaggccggggggtccctgagactctcctgtgcagcctctggcttcaccatcagtagagactacatgagcgtgggcccgccaggcctccgaggggaaggggctgggagtgggtctcgtagttattagtcgcgatggtggcacacactacgcagactccgagacggcagacttcaccgtctccagagacaattccaagaacagtggtatatcttacaaatcgaaactagaactaacgacgaccgaaggaccacgggaccttaattacttactggtagacggaagacctagtcgacgttacgggtgaccgtccccggtaggggacccctaacggg

SEQ ID NO: 58825 - DNA, 659 bp, Homo sapiens
  misc_feature: GYAE6OF02HBBH9.8.42.D09.1.454.CMB.1.raw
  modified_base (224)..(224): a, c, t, g, unknown or other
  misc_feature (224)..(224): n is a, c, g, or t
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctggtaccaacaacaccaggacaaacgccccaaactcatgtattttgagtcaatagccgcctcgacgggtcctgactcgcttcncagctcagtctgcacacgcctccgngaccgtctcgtcggtcctacgtagacctggacgtagtaggacggtctagtaacttacgttacctgactacgtctactattactttacgacgtacgaacggaccgtaaggtacggggtttaccgtacggggtacggggaaacgggtaacccgtaaaggtttccgggtaaccccggttacggttaaccgggtacccgaaccgggtaaccccggtaacgggtcccgttaccccgggtcccccgttacggggtacccctaacccgtttcccggttaccccgttacccccgaaccccgttaacccgg

SEQ ID NO: 58826 - DNA, 726 bp, Homo sapiens
  misc_feature: GYAE6OF02IK1MU.8.42.D09.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatcncctgcactggacnccagcagtnaattacaactagtactcctcctacggtaaccaaaccaaccaacccgacggaccaaaaccgacccccaaactaccgattacgtaatttttcggaagtactaaagtaacggccggaccccgtacggtaccggggtacccctcgtaacgttccgtcgttaccgtacgaacggtaccttaccgtaaacgttcggttacggaacccgaaaacgtacccgggtacccttcccgttacgtacccgttccgtccggttacgggccctttccgaacgtacgttagaacggtagtaccggagtccttaggtaagttacttacgtgaccgtcgtacgtactagttactcgaaggtcaaacgtccgaaacgtgggttaacgttaccgggacggggaacgtaaacgtacgttcggtacccgtacgtacggtaccgaacgaccggtaacggcctaccggtccccgttacggtcctaaccggttctaccgttccccgacccttacccgg

SEQ ID NO: 58827 - DNA, 705 bp, Homo sapiens
  misc_feature: GYAE6OF02GO6OU.8.42.D09.1.454.CMB.1.raw
  modified_base (250)..(250): a, c, t, g, unknown or other
  misc_feature (250)..(250): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctcgccctgactcagcctccctccgcgtccgggtctcctggacagtcagtcaccatcctcctgcacgtggacgccagcagtgattacaacttanactctcctggtaccaacaaccaccagacaaacgccccaaactcatacgtattttgacggtacaagtaacgccgcctacgtacggggtcctgactccgtcttctacgaggtacctaccgtaagtcgtcggaccaaaccgcccggtcccttacccgtacgtacccgtcgttccgtcggggtccctacccgtaacggacgttacggacggtagtacggtaaccgggtcttaacgttacgtttaacgtacgttcggtacacgtaccttcgttaactacgttaccgaacggtctaacgaacctaacgggtacgggttacggtacggggaacgggaacggtaccgtaacggttaccgtaccgttaccggtacggtaccgtacggacccggtaagggtccccttaccggtccccgttacggccgtaccgtccggtttacccgtaccccgtaccgttccccgg

SEQ ID NO: 58828 - DNA, 567 bp, Homo sapiens
  misc_feature: GYAE6OF02FR3ZS.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgccactggagccagcagtgattacaactatatctcctggtaccaacaacaccaggacaaacgcccccaaactcatgtattttgaggtacaataagcgccctcgaggggtccctgactcgcttctcaggctccaagtctggaccaacgaccgcctccctcgacccgtctcgtggcctccagactgaggatggaggctgtattacttactgcagctcatactcaggcagacaacgagggttacgttcgggacggtacggaccgtaaggttcgaccgttccgtaggtaccgacggacccgacggcctaccggccccgtcggtcctaccgttccttccgttcccccaccctcccg

SEQ ID NO: 58829 - DNA, 648 bp, Homo sapiens
  misc_feature: GYAE6OF02FYQHJ.8.42.D09.1.454.CMB.1.raw
  modified_base (230)..(230): a, c, t, g, unknown or other
  misc_feature (230)..(230): n is a, c, g, or t
  modified_base (318)..(318): a, c, t, g, unknown or other
  misc_feature (318)..(318): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcacgtggacnccagcagtgattacaactatatctcctgtaaccaacaaccaccaggacaaacgccccaaactcatgtattttgagtcaatagcgtccngacgggtccctgactcgtcttctacgaggtctacctagtcgtgacaacgccgcctcccgtcgtacccgtctccgtcgggtcctaccgacgtaccgtaggaacgggtattacggaggtccgttaggtaatttacgttaaccgttgactacgtccttacgtattaacgttcgacgacgtacgacgaaacgtgggttaacgttcggggacggtaacgggaacctaggttacggtacccgtacggtaacggtaccggtaaccggcccggtaaggtcccgttacccggcccccggttacggttacccaccggtttcccgtacccgttaccccccg

SEQ ID NO: 58830 - DNA, 554 bp, Homo sapiens
  misc_feature: GYAE6OF02GTCXV.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaagcccccaaactcatgtattttgaggtcaataagcggccctcgacgggtccctgactcgcttctcaggctccaagtctggcaacacggcctcctgaccgtctcgtggcctccgagactggaggtatggacggctgattatactgcagtctcattacttcaggcagaccaacgtagggttagttcgggcgggaacggaacctaaggttcgaccgtcgtaggtccacggacccaaggcctccgtcccccgtcggtcaccttcgtcgttccccacccgttcccg

SEQ ID NO: 58831 - DNA, 693 bp, Homo sapiens
  misc_feature: GYAE6OF02H8F88.8.42.D09.1.454.CMB.1.raw
  modified_base (224)..(224): a, c, t, g, unknown or other
  misc_feature (224)..(224): n is a, c, g, or t
  modified_base (289)..(289): a, c, t, g, unknown or other
  misc_feature (289)..(289): n is a, c, g, or t
  modified_base (338)..(338): a, c, t, g, unknown or other
  misc_feature (338)..(338): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggacnccagcagtgattacaactatatctcgtgtaaccaaacaacacccaagcaaacgccccaaatcatntattttgagtacaataagccgacctcgacgggtccctgactcgtcttcncgacggtcctaccgaagttctggacaaaccgaccggtccctaccgtcgtacccttctccgtggccttaccgagtaccgtaggacggtaagtcgaacggtccgttagtacgtttagttaactggtaccgacgtccttacgtatttaacttcgacgggactaccggaacgtaacggtaacgggttacgtaccggggtaacgggacggtaacgtaaacggtttaccggtaccgttaccggtacggtaccgtaccggtaacccgtaacgggtacccgttaccccggtaccccccggttagggttacccctaccggtttaccccgtttaccggttaccccccgtacccgttaacccccgg

SEQ ID NO: 58832 - DNA, 718 bp, Homo sapiens
  misc_feature: GYAE6OF02H6KUT.8.42.D09.1.454.CMB.1.raw
  modified_base (139)..(139): a, c, t, g, unknown or other
  misc_feature (139)..(139): n is a, c, g, or t
  modified_base (354)..(354): a, c, t, g, unknown or other
  misc_feature (354)..(354): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacngggtcctgggcccagtctgccctgactcagccctccctcgccgtccgggtctcctggacagtcagtcaccatctcctgcacgtggacgccagcagtgattaacaactatatcctcgtacgtaaccaacaacaccgaagaccaaacgaccccaaactcaatcgtattttgaaggtactaataagccgtcctcgacgggtccctagactcgtcttcncgacggtctacctagttcgtacggaccaacgacccggtacccttcccgtcggtaccctcttccggtcggtcctaccgaacgtacgtagggtaacggtacgtggacggtcctagttaactttacgttacgtcgaccgtacgtccgttaacgtattaacgttcggaacggtccgtaaacgaccgtaaaccgggtaggggttaaccgttcccggggaaacgggtaacgggtaaaccgtaaaccgggtttccggaacccgttcccggttaggtacccgaacggtaaccccgagggtcccctttacccggcccccgttggtaccctaccgtttccccggtcccggttaccccccctcccgttaccccgg

SEQ ID NO: 58833 - DNA, 780 bp, Homo sapiens
  misc_feature: GYAE6OF02IGP31.8.42.D09.1.454.CMB.1.raw
  modified_base (245)..(245): a, c, t, g, unknown or other
  misc_feature (245)..(245): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtccaccatctcctgcactggacgccagcagtgattacaactanatcctcctcgtaaccaacaaccacccaggacaaaacgcccccaaactcatgttaactttttggacggttacaaagttaacggcccgggtccctaccggtacgggggttccccttaggtaccgttccggtcctttccgtccgtaacgggtccttacccgtaaagttccgtacgggacaaccgtaccggtccctacccgtcggaacccgttcgtccggtcgggtccttaccgacgtacgtacggtaacggacgttacggacggtcgttagttacgtttaacgtttaccgaggtcctaggtaccttactaagtttaaccgtaggaacggtcctaacggacccgtaaacggttacggggtttaacgttaccgggggaccgaaacggggttaacccgtaacgggttccgggaaacccggttcccgttaaggggtaccgtaaccggtaccccggtaaacgggtcccgtacccgttacccccggttccgtaccgttacccggttaccgttaccccgggttccccgttcccccgttaacccgg

SEQ ID NO: 58834 - DNA, 855 bp, Homo sapiens
  misc_feature: GYAE6OF02JAQP1.8.42.D09.1.454.CMB.1.raw
  modified_base (281)..(281): a, c, t, g, unknown or other
  misc_feature (281)..(281): n is a, c, g, or t
tcagctcgcgtgtccacgaccggtgctcgatttagacacatacgcagggaaagggggggagaggagcccagcactgggattccgaggtgtgtccattcggtgatcagcactgaacacagaggactcaccatggagttctggctgggctgggttttccttgttgcaatttcaaaggtgtccagtgtgaggtgcagctggtggagaagtgggagggggcttgatccgaggccggggggtcctgagactctcctgtcgcagcctctgcttcaccatcagtaganactacagtgagcgtcgggccccgccgaggccgtaccggaaggggaacggggtcgtgggaggttcggggtctacgtagttttacgtttacgtccggtacggtagttcgggtacggaccgtaactaaccgtaaccgttaccggaccgtaaacgggtacccgttacccgggttacggggaaaaccgggggtctaaccgggttaaacccttttcccggaaacccccggggtttccctaaccccggtaaacggtaaccgtaaacccgttaaaccgttttaaacccggaaaaaccggtaaccgttaaagggtttacggggtttaacgttaactttaacccgtttaaccgtaaaaacgttcggtaaaaccctaaccggtaaaccgttaaaccggacccgggtacccggtaaaacgggaacccgtaaacccgggtacgttaaacgttaaccgtttaccgttagggtacggtaacccggtaaggtaaccctaagttacccggtaaccggtttaccggtacggggtaaccccgttaccccgggggtaccgggggtaccccggtaaccggggttaaacccccggg

SEQ ID NO: 58835 - DNA, 577 bp, Homo sapiens
  misc_feature: GYAE6OF02G6V5O.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagccagcagtgattacaactatatctcctggtaccaacaacaccaggcaaacgcccccaaactcatgtattttgaggtcaataagcggcctcgacgggtcctgactcgcttctcagctccaagtctggcaacacgcctcctcgaccgtctctcgggctccagactgagatgaggctgtattattacgtgcagtctacattctacaggacagacaacgtagggttacgttcgggacggacgggtaacgtaacggttcgacccgtcgttacggtaccgaacggacccgaacggtcctccggtccccccgtcggttaccacccgttaccgttccgttccccctaccccgttaccccg

SEQ ID NO: 58836 - DNA, 588 bp, Homo sapiens
  misc_feature: GYAE6OF02G6H6D.8.42.D09.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctcctgcactggacnccagcagtgattacaactntactctcctggtaccaacaacaccagacaaacgccccaaactcatgtattttgagtacaataagcggcctcgacgggtcctgactcgcttctcaggctaccaagtctggacacgacgtccctccgtgacccgtctacgtcggcctcgagtacgtgaggactggaggtctagtattacgttactgacctagtctacagttacttcgacggtcacgacgaacgtacgggtagtccgggacgggacgggtaacctaaggttcgacccgttcgtacggtccgacgtccgaacggcctacccgccccgttcggtcctaccgttccgtccggttccccgcctacccgg

SEQ ID NO: 58837 - DNA, 614 bp, Homo sapiens
  misc_feature: GYAE6OF02FNYON.8.42.D09.1.454.CMB.1.raw
  modified_base (228)..(228): a, c, t, g, unknown or other
  misc_feature (228)..(228): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgattacaactatatctcctgtaccaacaacacccaggacaaacgcccccaaactcatgtattttgaggtcaataagccggtccctcgacgggtccctgactcgcttcncncggctaccagtctgcaacgcggcctccctgacccgtctcgtggcctccgagcgtgaggacgtggacgtctagtattacttacgtcgcgtacgtcctatacttagttacaggctaggaccaacggtaggtagttcgggacggaacgggaccgtaggttaccgaccggtaccgttaacggtaccgaaccggtaccccgtaagggtcccgttacccggtcccccggtttaccggtacccgtaccccgttaccgttccccgttacccccccg

SEQ ID NO: 58838 - DNA, 577 bp, Homo sapiens
  misc_feature: GYAE6OF02HTJ5O.8.42.D09.1.454.CMB.1.raw
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (569)..(569): a, c, t, g, unknown or other
  misc_feature (569)..(569): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactgganccagcagtgattacaactatatctcctgtaccaacaacaccagcaacgccccaactcatntattttgagtacaataagcggcctcgacgggtccctgactcgacttctcgacggctaccaagttctcggaccaaccgaccggtaccctcccgtaggtacccgttccgtcgtcgggcctaccgagtacgtggaggacttggaggtctagtattaattacgtgcagtcctcgtaattatcgaggcacgacaagacgggttagtcgggcggaggaccgaagttcgaccgtccgtaggcgagacccaggccgttaccgccccgttcggccaccgttctccgttcccnccctcccg

SEQ ID NO: 58839 - DNA, 619 bp, Homo sapiens
  misc_feature: GYAE6OF02GIOZU.8.42.D09.1.454.CMB.1.raw
  modified_base (225)..(225): a, c, t, g, unknown or other
  misc_feature (225)..(225): n is a, c, g, or t
  modified_base (609)..(609): a, c, t, g, unknown or other
  misc_feature (609)..(609): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgattacaactatactctcctggtaccaacaacacccagacaaacgccccaaactcatgtattttgaggtcaatagcgccctcgacgggtccctgatcgcttctcacggcctccaagtctggacaaccgaccggcctcccgtcgacccgtccttcgtcgggccctaccgagtacgtaggacggtatcggaggtcgtagtaatttacttacgtgactacggtctactattactcgaggaccagactaacggtacgggttacgttcggggacggtaacgggacgtaacgttccgaccgttaccgtacggtaccaaccggtacccgaacgggtcctccgtacccccgttcggtaccctaccgttccgtcccgttaccccncccttacccg

SEQ ID NO: 58840 - DNA, 583 bp, Homo sapiens
  misc_feature: GYAE6OF02IQFAK.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagccagcagtgattacaactatatctcctgtaccaacaacaccaggacaaacgacccccaaactcatgtattttgaggtcaataagcgccctcgacgggtccctgatcgcttcctcgacggctaccaagtctggacaacgaccggcctccctgaccgtctcgtcgggcctccgagactggagatggagctagtattacttactgctagcttacatattcgaggacagacaacgtaggttacgtcgggacggacgggtacctaaggttcgaaccgtccggtaacggtccgaacggtcccgaacggcctacccggacccccgttacggtacccaccgttcccgttcccgttaccccccg

SEQ ID NO: 58841 - DNA, 710 bp, Homo sapiens
  misc_feature: GYAE6OF02IOU4B.8.42.D09.1.454.CMB.1.raw
tcagctcgcgtgtccacgaccggtgctcgatttagacacatacgcagggaaaggggggggttctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgcactggagccagcagtgattacaacttatactcctcctaggtaccaaacaaccaacccaggaccaaacgccccccaaactcatgtattttgacggtacaaagtaagccggccctacgacggggtccctgactcgtaccttctcgacgcctccgaagtcctaggacaaccgacggtcctcccgtcgtaccctcgttacgtcgggtcctaccgagtaccgtggaacggtagtggaacggtcttaggtaactttaacttaccgtggtacctacggttaccttactaacgtttaacgttcgaacgggtacaacggtaccgaaaggtacgggttaacgttcgggaccgggtaaacggggtaacctaaggttccggaacccgttacgtacggtaccgaacggtaccccgaaacgggttcccgtacccggtcccccggtttaccggtacccttaccgttacccttaccccggtttacccccacccccgttacccccgg

SEQ ID NO: 58842 - DNA, 569 bp, Homo sapiens
  misc_feature: GYAE6OF02FQMLE.8.42.D09.1.454.CMB.1.raw
  modified_base (225)..(225): a, c, t, g, unknown or other
  misc_feature (225)..(225): n is a, c, g, or t
  modified_base (558)..(558): a, c, t, g, unknown or other
  misc_feature (558)..(558): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcagtgattacaactatatctcctggtaccaacaaccaccaggacaaacgccccaaactcatgattttgagtcaatagcgcctcgagggtcctgactcgtcttctcgaggctcaagtctggccaacgaccggcctcctacgaccgttctcgtcggtcctccagacgtgaggtatggacggtctagaactttacttactgcgagcttcattactcgaggctagacaacgtacgggtagttcggacgggaggacctaggttcgaccgtcgaggtaccgacggtcccgaaggccctacggcccccgtaggtcctaccgttcctccgttccccncccgttacccg

SEQ ID NO: 58843 - DNA, 700 bp, Homo sapiens
  misc_feature: GYAE6OF02IQ1TA.8.42.D09.1.454.CMB.1.raw
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacgccagcagtgattacaactatactctctcgtaccaacaacaccagacaaacgccccaaactcatgtattttgaggtacaaagtaacggccggtcctcgacgggtccctgacgtcgtctctcacgctccgtaagtcgtaggacaaccgcggtccctcccgtacgtaccgtctcgtcgggcctaccgacgaccgtggaaggtacgtggtaacgggtcttaggtaactttaacgttacgcgtcctaggtcctactaagttacgttacgacgtcgaacgtaccgaaacggtacgggttaacgttcgggaaccgggtaacgggtaaccgttaaagggttccgtaacccggttaccgtaacgggttacccgaaaccggtaccccggtaaacgggtcccgtaccccggttacccccggttcggttaacccgttcccgttccccggttttacccggttccccccgtccccgttaacccccggg

SEQ ID NO: 58844 - DNA, 681 bp, Homo sapiens
  misc_feature: GYAE6OF02IKDHZ.8.42.D09.1.454.CMB.1.raw
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (352)..(352): a, c, t, g, unknown or other
  misc_feature (352)..(352): n is a, c, g, or t
  modified_base (450)..(450): a, c, t, g, unknown or other
  misc_feature (450)..(450): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatcctcctgcacgtggacnccagcagtnattaacaactatactctctacgtaacaacaaccaccgagacaaaccgaccccaaactcatgttatttgacgtacaagtaacgccgtacctacgcgggtcctgactcgtcttcncgacgtactacgtacgtcgtacggactaccgaccgtacctaccgtacgtaccttcgtacggtcggtcctaccgagtacgtggaacggtctaggacgtnttaagttaattacgttacgtctacgtacgtacgttactagttactacgacgacacgaaccgtaacggtacgggttaacgaccggggtaacggtaacgggtaaccgtaacgggttaccgtaaccgtacggttaacggccgtaaccggtaacccggtaacggtcccgttaccccgacccggttacgtaccgttaccgttccccggttacccgttcccccgacccgttacccgg

SEQ ID NO: 58845 - DNA, 714 bp, Homo sapiens
  misc_feature: GYAE6OF02G4X05.8.42.D09.1.454.CMB.1.raw
  modified_base (357)..(357): a, c, t, g, unknown or other
  misc_feature (357)..(357): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctctgcacgtggacgccagcagtgaacttaacaactatactcctccgtacgtaaccaaacaaccaaccgacggaccaaaccgacccccaaactcagttgttattttgacggtacaagtacgccggtccctcgacgggtcccngtacgtccgtcttccacgacggtcctaccgtaagttccgacgaccaaccgccggtccctccgtacgtaccgtcgtccgtcggtccaccgacgcgtagggacggtcgtaggacgtctaagttactttacgtacgtgccgtaagccttattaacgttacgttaccggacggtacgaacccgtaacgtaaccgggttaaggggttaccgtccgggggaaacgggtaacggtaaccgttaagggtacccgttacccgggttacgggtaaccggtaacccgaccggtaaccccggtaggttacccgtccccgggttaccccgtccgtaccttaccccgttccggtttaccccgtaccccccg

SEQ ID NO: 58846 - DNA, 714 bp, Homo sapiens
  misc_feature: GYAE6OF02G215R.8.42.D09.1.454.CMB.1.raw
  modified_base (224)..(224): a, c, t, g, unknown or other
  misc_feature (224)..(224): n is a, c, g, or t
  modified_base (290)..(290): a, c, t, g, unknown or other
  misc_feature (290)..(290): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatactctctggtaccaacaacacccaggacaaacgccccaaactcatntattttgaggtcaataacgccgcctacgacgggtccctgactcgcttctcgagtctaccaagtctggacaacgaccgcctccgcgtaccgtctcgtcggcctaccgagtacgtcgaaggctagacggtacttggtaatttaacgttaccgttgaccgtacggtaccttacgtaacgtttaactttacccgaagggtacctaacgggtaaccgtaaaccggtaacgggggttttaccgtttacccgggggaaacgggttaaccgggggtaaacccttaaacggggtttccgggaaccccggtttaccgttacgggttacccgaaacggtaccccggtaaacggtcccgtaacccgggtccccccgttacgggtcccgttaaccgttccccggtttacccgttacccccgtaccccgttaccccgg

SEQ ID NO: 58847 - DNA, 769 bp, Homo sapiens
  misc_feature: GYAE6OF02IJNDT.8.42.D09.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
tcagctcgcgtgtccacgaccggtgctcgatttagacacatacgcagggaaaggggggggtctcgaggaggcagcgctctcaggacgtcaccaccatggcctgggctctgctcctcctcaccctcctcactcaggcacagggtcctgggcccagtctgccctgactcacgcctccctcgcgtccgggtctccgtggacngtcagtcacatctcctgcactggacnccagcagtgattacaatatntctctgtaccaacaaccaccaggaccaaacgaccccaaactcatagtattttagaagtctaaagtacgaccgtccctacgacgggtaccctgtactcgtacttcgtacgacggtcctaccgaagttcgtacggactaaccgaccggtccctaccgtacgtacccgttcctccgtcggtcctaccgaacggtacgtggtaaggactacgggacggtacttagtaacgtttacgttaacgtcggaccgttaacgtcttaactatttaacgttaccgaaggtacctaaacggtaacctaaacgggttaaccggggtttaacgttacccggggggtaacgggaaccgggtaaaccgttaaaccgggtttccggtaaccccggttaccgttacgggggtaacccgtaacccgggaacccggtaaacggggttaacccggttcccccggtaacccccggtttcgggtaaccccgttaacccggtttacccgttaccccgggtttcccccccggtacccccttaccccggg

SEQ ID NO: 58848 - DNA, 605 bp, Homo sapiens
  misc_feature: GYAE6OF02HZUO1.8.42.D09.1.454.CMB.1.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcaagtgattaacactatatctcctggtaccaacaacaccaggacaaacgcccccaaatcatgattttgacgtanaatacgcgcctcgacgggtccctgactcgcttcncgngctaccagtcgtcgacaacacggcctcccgtagtacccgtctacgtcgggcctacccgaagaccgttgaggtacgtaggacggtcttaggtaactttagttactggtactacgtactacgtaatacgttcaggtacagacgaagtacggtagtcggacgggtacggaactagtccgaccgttactacggtacgaccgtaccgaacggtcctaccggtcccccgtacggtccgtaccgttccgtccgttccccgacccgttcccg

SEQ ID NO: 58849 - DNA, 701 bp, Homo sapiens
  misc_feature: GYAE6OF02F75DE.8.42.D09.1.454.CMB.1.raw
  modified_base (228)..(228): a, c, t, g, unknown or other
  misc_feature (228)..(228): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcaggcacagggtcctgggcccagtctgccctgactcagccctccctccgcgtccgggtctccgtggacagtcagtcaccatcctcctgcacgtggacnccagcagtgacttacaatatactcctcctgtaccaacaacaccagacaaccgccccaaactcatgtattttagaggtacaatacgcgccctcgacgggtccctagactccgctttacgtcgtacggtcctaccgtaacgtccgtacgtaccaaccggaccggtccccttccgtaccggtacccgtctcccggtcggtcctaccgtacgcgtaggacggtagtacggacggtctaggtaactttaacgttcgtacgacgtactcgttacgtattcgtacgtacggcacgtacgaacgtacgggttacgttaccgggacgggtaaacggtaccgtaaacggttacggtacccggttaccgttaacgggtaccgtaacggtacccggtaaccgggcccgttacccgtacccccggttaccgttcccgtaaccccggttcgtttacccccggttaccccgtaccccgtttaccccgg

SEQ ID NO: 58850 - DNA, 673 bp, Homo sapiens
  misc_feature: GYAE6OF02GC91K.8.42.D09.1.454.CMB.1.raw
  modified_base (523)..(523): a, c, t, g, unknown or other
  misc_feature (523)..(523): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggacgccagcagtgattacaactatatctcctggtaccaacaacacccagcaaacgcccccaaactcatgtattttgaggtacaagtaagccggccctggacgggtccctgactcgtcttctcgacggtcctaccgagtcgtaggaccaaccgaccggtacccttcccgacgtacccgttctccgtcggggtccctacccgtacggaccttagggaacggtatggaacggtcttaggtaatttacgttactggctacgtaccttctattacttccgaggacgtacgacaaggtacggggtnttacggggacggtaacggacccgtaagggttacgccccggttacggttacggtaccggaacggtaccccgtaaggtacccgtcccggtccccggttaccggttaccgtacccttccggttacccgtttcccccccggacccttaccccgg

SEQ ID NO: 58851 - DNA, 782 bp, Homo sapiens
  misc_feature: GYAE6OF02FNQSP.8.42.D09.1.454.CMB.1.raw
  modified_base (224)..(224): a, c, t, g, unknown or other
  misc_feature (224)..(224): n is a, c, g, or t
  modified_base (341)..(341): a, c, t, g, unknown or other
  misc_feature (341)..(341): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctgtaccaacaacaccaggacaaacgacccccaaactcatgtattttgacggtcaataagccgcctcgacgggtccctgactcgcttctacncggtctcgaagtctggaccaacaccggcccttccctcgtacccttcgtccgttcgggccctaccgacgtacgtaggtacggaagtcggaagggtccgttaggttaactttaaacgtttaccgtacgtaccgtaacggtccttacgtaaacttacgtttaaccgtaacgggtccgtaaacggtacccgtaaaacgggttaacgggggtttaaccggtttaccgggggaaccgggggtaaaccggggtaaacccggttaaacgggtttacccgggttaaccccgggttacccggttaacgggggttacccgtaaccggggtaacccccgggtaaaccggggtccccgttaccccggtcccccccgggtttaccgggttacccgttaacccggtttcccggtttccccgggtttacccccccgtacccccggtttaccccccgg

SEQ ID NO: 58852 - DNA, 645 bp, Homo sapiens
  misc_feature: GYAE6OF02HSFRQ.8.42.D09.1.454.CMB.1.raw
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
tcagctcgcgtgtccacgaccggtgctcgatttagacacatacgcagggaaaggggggggctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatcctcctgccactggacnccagcagtcgattaccaactatactctccgtacggtaccaacaacacccaggacaacgccccaaatcatntatttgagtacaatacgcgcctcgacgggtccngatcgcttcgcagctaccgagtcgtacggactacgccgcctccgtcgtaccgtctcgtcggtcctccgacgtacgtcgacggtacgtacggacggtacgtagtacgttaacttacgtcgtacaacgttccgtatacttacgtacgacgacacgaacgtacggtagggttacgtacgggacggaacgggtaacgtaacgttacgaccgttacgtacggtaccgacggaacccgtaacggtccgtacccggtcccccgttacgggtacccgttacccgtttccggtacccggtttcccccggtacccgttaccccgg

SEQ ID NO: 58853 - DNA, 642 bp, Homo sapiens
  misc_feature: GYAE6OF02HMOQP.8.42.D09.1.454.CMB.1.raw
  modified_base (226)..(226): a, c, t, g, unknown or other
  misc_feature (226)..(226): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggacnccagcagtgattacaactatatctctgtaccaacaacaccagacaaacgccccaaactcatgtattttgagtacaataacgcgcctcgacgggtcctgactcgcttctcgacggtctaccaagtcctaggacctaactaccgttccctcccgtacgtacccgttcgtccgtacgggtccttaccgaagtacgtacgggagtaacgttagggacgtacgttagtaactttaacgtttacgtacgtactacgtctacttattacttacgaggtacaacgacgaacggtagggtacgttcgggacgggtaacggtactaaggttcgacccgttacgtacggtacgaacggacccgtaaggccgtcccgtaccccgtcggtacctaccttccgtacccgttaccccgtacccttacccgg

SEQ ID NO: 58854 - DNA, 673 bp, Homo sapiens
  misc_feature: GYAE6OF02HGQLB.8.42.D09.1.454.CMB.1.raw
  modified_base (229)..(229): a, c, t, g, unknown or other
  misc_feature (229)..(229): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctccaccctcctcactcagggcacgagggtcctgggcccagtctcgccctgactcacgccctccctccgcgtccggtctcctggacagtcagtcaccatcctcctgcactgganccagcagtgattacaactatatctcctgtaaccaacacaccagacaaacgaccccaactacatagttacttttagtagtaccgaataaacgccgtccgtacgacgggtacccgtgacgtcgtcttctcgacggtctacctaagtcctggacctaaccgacccgacccctccgttcgacccgtcgttccggcggtaccgcctagaccgtaggtaggtacgtcggaggtactagttactttacgttaactcggactcgtactcgtaatccgtancggtanacgacgtaacgaaggggttacgttacggggccgggaacggtaaccgtaacgggttacggtacccgttcccgtaaggtcccggtaaccgtacccgaaccgggtccgtcccggaccccgttcggtaccgtacccgttcccgttccccggttcccgttcccccgtcccg

SEQ ID NO: 58855 - DNA, 636 bp, Homo sapiens
  misc_feature: GYAE6OF02JD1GI.8.42.D09.1.454.CMB.1.raw
  modified_base (427)..(427): a, c, t, g, unknown or other
  misc_feature (427)..(427): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcgagggcacagggtcctgggcccagtctgccctgactcagccctccctccgcgtccgggtctcctggacagtcagtcaccatctcctgcactggacgccagcagtgattacaactatactctctgtaccaacaaccaccagacaaacgcccccaactcatgtattttgaggtcaataacgccgcctacgacgggtcctgtactcgtcttctcgacgctacagtcgtacgacaacaccggtccctccgtacgtacccgtcctaccgtcgggtacctccgaacggtctaggaccggtancgggtacgcttaggtaatttacttacgcgtacgaacgtccttacaattcgtacgaccgtcgtacgtactaacggtagggttacgttacccggggagggaaccggtaacgacggtttacgtacccgtacgttacggcccgaaggtacccgaggtcccctacggtccccgtacgtcctaccgttccttaccgttaccccgtacccgtcccg

SEQ ID NO: 58856 - DNA, 673 bp, Homo sapiens
  misc_feature: GYAE6OF02FJM0J.8.42.D09.1.454.CMB.1.raw
  modified_base (226)..(226): a, c, t, g, unknown or other
  misc_feature (226)..(226): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctggcccagtctgccctgactcagcctccctccgcgtccgggtctcctggacagtcagtcaccatcctcctgccactggacncccagcagtgacttacaactatactctcctggtaccaacaaccaccaggccaaacgcccccaaaactcactgtatttttgaggttcaaataagcggccctcgacgggttccctgactcgtctcgcgacgcctacgtagtcgcgtacaacgaccgtccctcgacgtaccttccgtcggtcggtacctaccgtacgtacgtacgaacggtacgtacggaacgtcgttaagttaactttaacgttacgttacgaccgtacgtcctacgtacttacgtaccgtacgtacgaccgtaacgtaacggtaacggttaacgtacgggtaccgggaacgtaacggttacgtacccggtacgtaccgtacggaccgtaaccgaccggtaaccgccgttaccccggcccggttacgtaccgtacccgttccgtaccccgttaccctacccgtacccgg

SEQ ID NO: 58857 - DNA, 609 bp, Homo sapiens
  misc_feature: GYAE6OF02I4CV7.8.42.D09.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (472)..(472): a, c, t, g, unknown or other
  misc_feature (472)..(472): n is a, c, g, or t
  modified_base (589)..(589): a, c, t, g, unknown or other
  misc_feature (589)..(589): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcaggcacaggtcctgggcccagtctcgccctgactcagcctccctccgcggtccggtctccgtggacngtcacgtcaccatcctctgcacgtggacncagcagtcgattacaactntatctctcgtacaacacaccagacaacgacccaacncatcgtatttgagtacaatagaccggtccacgacggtcctagactacgtcttcgtacgacgtccgtacctagtctcggactaaccgccggtacctcccgtagacccgttcgtcgtcggtacctacgtacggtcgtaggtacgggacttggaacggttctaaggtactttacgtaacgtcgacgtacggtntacgttacttacgtacgagggtaacacgacgacgtaggttcgtacgggacggtacgacgtaacgtcgtaccgtacgacggtcgcggtaccacgccgtaccgtcccgtacgccttacnccgttcctccccgtactccg

SEQ ID NO: 58858 - DNA, 663 bp, Homo sapiens
  misc_feature: GYAE6OF02HIZW2.8.42.D09.1.454.CMB.1.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (341)..(341): a, c, t, g, unknown or other
  misc_feature (341)..(341): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacntctcctgcactggacnccagcagtnattacaactntatctcctgaaccaacaacacccaggacaacgaccccaaactcatgtatttttagaggtacaataacgcggcctcgacgggtccctgactcgtcttcncaggctaccagtcgtcggacaacgccgcctcccgtacgaccgtctcgtcggcctccgagactagacggtatacggaggtctagtaattacgttagtacgacgtagtctactaattactcgaaggtcaagaccaacgtaggggttaacgtcggggaaccgggtaacgggtaaccgtaaaggttaccgtacccggttacgtaacgggtacccgtaaccggacccggtaaacggtcccgttacccggtaccccccggtttacggttacccgttacccggttcccggtttaccccggtttacccccgtaccccggttaacccccgg

SEQ ID NO: 58859 - DNA, 611 bp, Homo sapiens
  misc_feature: GYAE6OF02F9BUW.8.42.D09.1.454.CMB.1.raw
  modified_base (229)..(229): a, c, t, g, unknown or other
  misc_feature (229)..(229): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatcctcctgcactggacnccagcagtgattacaactatactcctcgtcgtaccaacaacaccagacaaacaccccaaactcatagtatttagagtacaatacgcgcctacgacggtccngtactcgtcttcncacgctacagtctgacacncgcctcncgtactctcgcggcctacgagtcgtagagtacgtgacgtctagtattactacgtcgacgtagtcctatacgttacgtacgagtcgaacgtaactaacggtacggttacggttcgggacggtaacggtaacgtaacggtaccgtacgttacgtacggtaccgaaccggtaccgaacggttcctacccggtccccgttacggtccgtaccgttcccggtacccgttccccgtaccctaccccgg

SEQ ID NO: 58860 - DNA, 676 bp, Homo sapiens
  misc_feature: GYAE6OF02H9RJZ.8.42.D09.1.454.CMB.1.raw
  modified_base (228)..(228): a, c, t, g, unknown or other
  misc_feature (228)..(228): n is a, c, g, or t
  modified_base (360)..(360): a, c, t, g, unknown or other
  misc_feature (360)..(360): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtccaccatcctcctgcacgtgganccagcagtgaattaccaaacttatactcctacctcggtaaccaaacaacacccaaggaccaaaacgcccccaaatcatagtattttgagtacaagtaacgccggcctacgacgggtccctgactccgcttcncaggcctacgacgtctacggacaacgaccggtcctcccgtcgaccgtctaccgtggacctaccgagtactgacggtagtggagtctagtaacttactacgtgactacgtctacgtattacttcgaaggtcaacggaactaacggtacgggttaacgtccggggtacggaacgggtaccgtaaacgggtttcgaacccggttaccgtaacggttaccgaaccggtaaccccgaagggtacccgttacccgaccccccggttccggtacctaaccgtttccttaccccggtttaccccccttaaccccgttaccccgg

SEQ ID NO: 58861 - DNA, 684 bp, Homo sapiens
  misc_feature: GYAE6OF02IWJ7P.8.42.D09.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntcctcctgcactggacnccagcagtgattaccaatntatcctctgtaccaacaaccaccagacaacgaccccaaactcatgtattttgaggtcaagtaacgccgtccctcgacgggtcccngactcgtcttctcgacggtcctacctaacgtcgtacggaccaaccgccggtccctcccgtacgtacccgttctaccgtcggccctccgagtacgtcgaacggtagtggtaacggtccttaggttaactttacgttaacgtcgaccgtacgtccttactaacgttacttacgacgggtcaacgtaccgtaaacggtaacggggttacgttccggggaacggtaaccgggtaaccgtaacgggtttaccggacccgttaccggtacggtaccgaaccggtccggtaacggtcccgtaccgtcccccgtacggttacctacccgttcccgtacccggttaccccctacccgtcccgg

SEQ ID NO: 58862 - DNA, 716 bp, Homo sapiens
  misc_feature: GYAE6OF02HPWOR.8.42.D09.1.454.CMB.1.raw
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcagtgattacaactatatcctcctggtaccaacaacaccagacaacgccccaaacncatgtattttagagtacaataacgccgcctcgacgggtccctgactcgcttcacgacgtctaccagtcacgacaaccgacgtccctccgtcgtacccgtctaccgtcgggcctacccgacgtacgtggaacggtacgtacggacggtccgttaaggttactttacgtttaccgtcggtaccgtaacggtccttactaacgtttacgttccgtaacggtaccgtaacggtaccgtaaacggtaagggttaaccggttaccgggaaccggggtaaccgggtaaacgtaacgggttacccggtaccggttacccgttacgggtacccgtaaccggaccccggtaaacgggtcccgtaccccggtaccccccggttcggttacccgtacccggtttcccgttaccccggttaccccctacccccgtttaccccgg

SEQ ID NO: 58863 - DNA, 751 bp, Homo sapiens
  misc_feature: GYAE6OF02HDIQL.8.42.D09.1.454.CMB.1.raw
  modified_base (250)..(250): a, c, t, g, unknown or other
  misc_feature (250)..(250): n is a, c, g, or t
  modified_base (683)..(683): a, c, t, g, unknown or other
  misc_feature (683)..(683): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctccaccctcctcactcgagggcacgacgggtccgtcgggcccagtctcgccctgactcacgtccctcccgtccggccggtccgggtcctccgtggactacgtcacgtccaccatcctccgtgctacgtggacnccagcgagtagtaacttacaattatacgttcctaccgttacggaacctaaaccaaccaacccgaacggaaccaaacccgaaccccctaaagtcgtaagttacgtttagttttacggaacgtacgtaaaacgtaaccggcccggtacccgtaacgggtcccgggtaccgttagtacgttcggtaccttcgtacgtaaccggtcctaaccgtaggtccgtacgaaccgaaaccgtcccgtcccgtacccgtaccggtaccgttacgttaccggccggtaccctacgaaccggtcgtagggtaacgaaggtcggaacggtcgttaagttaactttacgttaccggtcgacgtacgtaccttacgtattcgtaacgacgaccgtaagaccgtaacggtgggttacgagggtaccgaacggtacgtacgtcgtaccgngtacgtacggacgccgacggtccgtaccgtccgtacgtcctcccgtacctcccgtaccgtacccgtcg

SEQ ID NO: 58864 - DNA, 683 bp, Homo sapiens
  misc_feature: GYAE6OF02GU004.8.42.D09.1.454.CMB.1.raw
  modified_base (142)..(142): a, c, t, g, unknown or other
  misc_feature (142)..(142): n is a, c, g, or t
  modified_base (486)..(486): a, c, t, g, unknown or other
  misc_feature (486)..(486): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacngggtcctgggcccagtctgccctgacctcagccctccctccgcgtccgggtctccgtggacacgtcagtccaccatcctccgtgcacgtggacgccagcgagtgacttaacaactatatccttcctggtaaccaacaaccaccgagccaaacgccccccaactcatgtattttggaagtactaagtacgccggtccctcgtacggggtccctagacttcgtcttcgtcacggcctaccgtagtcgtgaccaaccgccggtccctcccgtagacccgttccgtcgtccgggacctaccgtagacgtggaacggtagtacggcggtactagttagttaacttacgngtaccgaagtccttactattccgtacgacggtacaacgtacctaagggtacggttacgttaccgggacgggtaaccgtaacgagggtttaccgtcccgttaacgggtaccggtaccgaacggtaccccggtaaggtcccggtacccggtcccccgggttaactcccgtaaccggttcccgttcccgttaaccccccg

SEQ ID NO: 58865 - DNA, 544 bp, Homo sapiens
  misc_feature: GYAE6OF02JIL52.8.42.D09.1.454.CMB.1.raw
  modified_base (223)..(223): a, c, t, g, unknown or other
  misc_feature (223)..(223): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactgganccagcagtgattacaactatactctctggtaccaacaacaccaggacaacgcccccaaactcatgtattttgagtcaatacgcgccctcgacgggtccctgatcgcttctcgacgctccaagtctggacaacgacggcctccgtcgaccgtctacgtcggcctcagtactgaggntaggagtctagtattatcgtgacgngtctactatacttcgagcacgacaacgtaggtacgttcggacggtacggactagtacgaccgtcgtacggcgacgaccaggcctccgcccgtcggtctaccgtccgtcgtcccgccctccg

SEQ ID NO: 58866 - DNA, 731 bp, Homo sapiens
  misc_feature: GYAE6OF02GL1NS.8.42.D09.1.454.CMB.1.raw
  modified_base (721)..(721): a, c, t, g, unknown or other
  misc_feature (721)..(721): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcacctcctcactcagggcacagggtcctgggccagtctgccctgactcagcctcctccgcgtccgggtctcctggacagtcagtcacatctcctgctacgtggactccagcctagtcgtattacgaactatactctaccgtgtaccaacaaccaccgagacaacgcccctaaatcacttgtacttttacgacggtactaagtacggccgtcctacgacgggtccctagtactacgtcttacgtcgacggtcctaccgtaacgtccgtacggaccaaaccgtccggtaccctacccgtacgtaccccggttctaccggtaccgggtaccctaccggtaacggtaccgttacgggaacggtaacgttcggtacgggtaaccgttaggttaaacgtttaaccgttaccgtacgggtacctaacggttcctttacgtaacgtttaccgttacggtaccggtaccgtaacgaaccgttaaccggtaacgggttcgtaaccggggacgggtaacgtaacggttacggttacgacccggttacgtcgtaccggaccgtaccggtacgtccgttacccgtccggttacgtctaccgtcgtacccgttacccnccgttaaccg

SEQ ID NO: 58867 - DNA, 657 bp, Homo sapiens
  misc_feature: GYAE6OF02IV5NO.8.42.D09.1.454.CMB.1.raw
  modified_base (224)..(224): a, c, t, g, unknown or other
  misc_feature (224)..(224): n is a, c, g, or t
  modified_base (369)..(369): a, c, t, g, unknown or other
  misc_feature (369)..(369): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggacnccagccagtgattacaactatatctcctggtaccaacaaccacccaggaccaaacgacccccaaactcatgtattttgaggtacaataagcggcctcgacgggtcctgactcgtcttctcgacgtctaccaagtctggaccaacncggccctcctcgtacccgtctcgtcgggcctaccgcgtaccgtgacggtacgtggacggtctggtaatttaacgttacgtcgtacagtacttactattacgttccgaacgggtacaccggtacgtaaacgtaacggggttaacgttcggggaccgggtaacgggtaaccgtaaagggtttacggaacccggttacgttaacggtccgaacggtacccgaaccgggtcctacccggccccgttacggtccctaccgtttacccgtccgttcccccgtacccgttccccg

SEQ ID NO: 58868 - DNA, 719 bp, Homo sapiens
  misc_feature: GYAE6OF02FHN9Z.8.42.D09.1.454.CMB.1.raw
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcacctatcctcctgcactggacnccagcagtnattacaactntatctcctgtaccaacaaccaccagacaacgccccaaactcatntattttgagtcaatagcgcctcgacgggtccngatccgcttctcgacggtcctaccgtaacgttcgtcggacctaaaccgaccggtcccttcccgtacggtaacccgttcgttccggtccgggtcccttacccgagtacccgttggaacgggtactacgggtacgggtaccttaggtaactttaacgttaaccgtcggtaacctaacggttacctacttaacgtttaactttaccggaacggttaccgaacggtacctaacgggtaacggggtttacgtaccggggtacgggaaccgggtaaaccgttaggttaccgacccggtttaccgtagggtccgaaccgtacccggaacggtcccgtccggtaccccccgttaggtcccgtaacccgttccgttacccggttcccccgtacccttacccccg

SEQ ID NO: 58869 - DNA, 729 bp, Homo sapiens
  misc_feature: GYAE6OF02JGF20.8.42.D09.1.454.CMB.1.raw
  modified_base (256)..(256): a, c, t, g, unknown or other
  misc_feature (256)..(256): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcacccttcctcactcgagggcacagggtcctgggcccagtcctgccctgactcagcctccctcgcgtccgggtctccgtggacacgtcagtcaccactccttcctgcacgtggacgccaggcagtgacttacaaacttntactcctcctaggtacccaacaaccacccacggaccaaacgccccctaaaatccagttgttattttaggacgtactaaacgtacggtccggcccgttacggtaccggggttccctagtacgtaccggtctttaccgacgtacggtcccgttaaccgtacgttacccggtggaacccaaaccggtccgggtaccccttacccggtacgtaaccccgttcgtaccggtccgggtacctccgacgtacgtacggtaggtagttacggacgtgttagtagtttacgttactggtcctaaggtcctagtacttagttacgacgcgacgtaacgtaacggtacggttacggtcgggaccgggtacgggtaacgtaagtacggtaccgtccgtaaggtcccgaacgggtacccgaacggtccgttacccgtcccgtacgttcccgaccgttaccttcccgttacccgtccccttacccgg

SEQ ID NO: 58870 - DNA, 643 bp, Homo sapiens
  misc_feature: GYAE6OF02GP9HN.8.42.D09.1.454.CMB.1.raw
  modified_base (209)..(209): a, c, t, g, unknown or other
  misc_feature (209)..(209): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntcctctgcacgtggacgccagcagtgacttacaactatactcctcctggtaaccaacaaccacccaggacaaacgacccccaaactcatgtattttgaggtacaatacgcgcctcgacgggtcctgactcgtcttctcacggtctcagtcgtcggacaaccgacggccctcccgtcgacccgtctcgtcggtcctaccgacgtcgtaggaaggtagtggacggtctaggtactttacttacgtacgtcgtacgtccttacgtacttacgttacgaggccgtaacgaccgtaaacggtacgggttaggttccgggacgggaacggtacgtaacggtcgtaccgttcgtacgggtaccgtacggacccgaacgggtccctaccggtccccgttccggtcctaccgttccgtcccggttcccccgtccgttcccccg

SEQ ID NO: 58871 - DNA, 696 bp, Homo sapiens
  misc_feature: GYAE6OF02JNSC8.8.42.D09.1.454.CMB.1.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (321)..(321): a, c, t, g, unknown or other
  misc_feature (321)..(321): n is a, c, g, or t
  modified_base (442)..(442): a, c, t, g, unknown or other
  misc_feature (442)..(442): n is a, c, g, or t
tcagctcgcgtgtccacgaccggtgctcgatttagacacatacgcagggaaaggggggggtcgtcaggaggcagcgctctcaggacgtcaccaccatgcctgggctctgctcctcctcaccctcctcactcaggcacgagggtcctcgggcccagtctcgccctcgactcagtccctccctccgcgtcccgggtctccctggacagtccagtccacctatcctcctgcacgtggacnccagcagtgaacttacaactntactctctacgtaccaacaaccaccagacaaacgaccccaactcatctattttcgagtacaanacgccgcctcgacgggttccctagtacgtctcgttacctcgacggtccttaccaaggttctcggaccgaaccgacccgtcccgtaccctcggacccgttacttcggtcggcctccgaacgnttacggaggtacgtacggaggtaccgttagtacttacgtttaccgtacgtaccgacgttaccgtactacttaagttccgaacggacgtaacgaccgaacggtagggtacgtaccggggtaccgggtaacgggtactaacgggttaccgtaccggttaccgtacgggaccgtacccggtaaccggacggtacccgtcccggtacccccgtccggtccgtaccgttccttacccggtaccccttacccgtaccccg

SEQ ID NO: 58872 - DNA, 692 bp, Homo sapiens
  misc_feature: GYAE6OF02FNNJ6.8.42.D09.1.454.CMB.1.raw
  modified_base (226)..(226): a, c, t, g, unknown or other
  misc_feature (226)..(226): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggacnccagcagtgattacaactatactctcctcggtaaccaacaaccaccgaggaccaaacgacccccaaactcatagtattttagagtacaataacgccgaccctcgacgggtcctagactccgtcgttctacgacggtcctaccgtaagtccgtacggaccaaccgtaccggtccccttacccgtacgtaaccccgttccgttccggtcggggtacccttaccgaacggtacctagggtaaccggtaggtacggacggtcttaaggttaactttaagtctacgacgtacgtactactaacgttacgttcgaacggcacgaactaacgggtaggttacggttccggacgggtacgtaacgtaacggttacggtaccgttacgaggtacccgacggacccgtaacggtcccgtaccgtaccccgtcggttacctaccgttacgttccccgttacccctcccgtaacccgg

SEQ ID NO: 58873 - DNA, 652 bp, Homo sapiens
  misc_feature: GYAE6OF02JF6GD.8.42.D09.1.454.CMB.1.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (469)..(469): a, c, t, g, unknown or other
  misc_feature (469)..(469): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggccagtctgccctgactcagcctccctccgcggtccgggtctccgtggacagtcacgtccaccatctccgtagcactggacnccaggcaggtnaacttaacaactatatcctcgtacggtaaccaacaaccaccgacggaccaaaccgacccctaaactcaatgttatttaggacgtacaagtacgccgcctacggcggtccagctcgcttctcgacgtcctacgtacgtcgtacgacgaacgccggtcctccgtacgtacccgtctcgtcgggcctacgagtacgtggacgtagtcggacgtctagttatttacgtacncggtactacgttctaattacttagtaccgagtaccaggtaacccgaagggtacgggttacgtcggggtaaccgaagggtacctaaggttccgaaccgttcgtaacgaccggaccgtaccgaacggtcctaccccggtccgttacgtaccgttaccttccgtacccgttaccctcccgtaaccg

SEQ ID NO: 58874 - DNA, 633 bp, Homo sapiens
  misc_feature: GYAE6OF02GB75S.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggacgccagcagtgacttacaactatactctcctcgtaaccaacaaccacccaggacaaaccgacccccaaactcatagtattttgagtacaataacgccggccctcggacgggtccctgactccgtcttctcgacggcctaccgtaagtcgtacggaccaaccgtaccggtccctcccgtcgtacccgtctccggtcggcctaccgacgtacgtaggaggtagtggacggtctgtactttaactacgtcgactacgtctctaattactacgacggtacagtaacgaacgtacgggttagtaccggggacggtacgggtaacgtaacgttcgaccgttcgtacggtcgaaccgaccgtacggccgtcccgccccgttcgtacctccgttcccgtccgttccccgcccctccg

SEQ ID NO: 58875 - DNA, 650 bp, Homo sapiens
  misc_feature: GYAE6OF02I0RCA.8.42.D09.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (370)..(370): a, c, t, g, unknown or other
  misc_feature (370)..(370): n is a, c, g, or t
  modified_base (481)..(481): a, c, t, g, unknown or other
  misc_feature (481)..(481): n is a, c, g, or t
  modified_base (587)..(587): a, c, t, g, unknown or other
  misc_feature (587)..(587): n is a, c, g, or t
tcagctcgcgtgtccacgaccggtgctcgatttagacacatacgcaggggaaagggggggggtctcaggaggcagcgctctcaggacgtcaccaccatggcctgggctctgctcctcctcaccctcctcactcgagggcacgagggtcctgggcccagtcctgccctgacctcacgcctccctcgcgtccgggtctccgtggacagtcagtcacatctctgcacgtggacnccagcagtgtattaacaactntaactctaccgtacgtaaccaacaacaccgaggaccaaaccgccccaaaacgtcatagtacgtttagacgtacaagtaacgtccggacctaggacgggtccagtacgtcgtccttacncgtacggacctaccgtaacgtgtacggaccaaacgtccgtccctccgtcgtaccgtctcggtcggtcctacacgtacgtgacgtaggagtcgtagtcgtaattactaccgngtccagtccctagtactactcggacggtacacggacgtaacgtaacgggttacggtcgggaacggtaccggaacgttaacgtaccggaccgttacgtacgggtacnccggaccgagtcccgttaccggacccgtcggcctaccgttccggtccgtacccgtcctacccg

SEQ ID NO: 58876 - DNA, 692 bp, Homo sapiens
  misc_feature: GYAE6OF02JV81Z.8.42.D09.1.454.CMB.1.raw
  modified_base (142)..(142): a, c, t, g, unknown or other
  misc_feature (142)..(142): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (372)..(372): a, c, t, g, unknown or other
  misc_feature (372)..(372): n is a, c, g, or t
  modified_base (403)..(403): a, c, t, g, unknown or other
  misc_feature (403)..(403): n is a, c, g, or t
tcagctcgcgtgtccacgaccggtgctcgatttagacacatacgcagggaaagggggggtcgtcgaggaggcgagcgctctcaggacgtcaaccaccatggcctgggctctgctcctcctcaccctcctcacctcaggcacngggtcctgggcccaggtctgccctgactcagccctccctccgcgtcccgggtcctcctggaccncgtcacgtcaccatcncctgccactggacncagccagtgaattacaactatactctcctagtacctaacaacaccaggaccaaccgacccccaactacatacgtattttagacggtactaaagtaagcccggtcctacgaccgggtccctagtactcgccgttacncgtacgtcctacaacgtctacgccgtaaacnccggtaccctccgtacgacccgttccgtcgtaccggggtcctaccgacgtacctagggacggtaacgtggaacggtacgtcggttaatttaccgttacgtacgaccgttcgtacctaccgtaagttacgttacgcggtacacggtacacggttacgggtagtcccgggtacggacgggtactaacgtacgacccggttacgacggtaccgaaccgtccgtaacggccccgtacggtccccccgtaggttacccgacctttcccggtaccgttcccccgcccgttacccg

SEQ ID NO: 58877 - DNA, 632 bp, Homo sapiens
  misc_feature: GYAE6OF02F14V5.8.42.D09.1.454.CMB.1.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (459)..(459): a, c, t, g, unknown or other
  misc_feature (459)..(459): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcaggcacaggtcctggcccagtctgccctgactcagcctccctccgcgtccggtctcctggacagtcagtcaccatctcctgccactgganccagcagtnattacaactatactctccgtcgtaccaacgaacaccagaccaaacgcccccaaatccatgtatttttgacgtacaagtaacgccggccctcgacgggtcctagactcgtcttctcgcggcctacctaagtctacggaccaaccgtaccggccttcccgtcgacccgttcgtacgtcgggcctccgaagtcgtaggagacgtcggacggtcttaggtaatttacgttacgngtcgtacgtctactaacttcgtcgtaggactacggaactaacggtagggttacgtcgggacggtaaccggtaacgtaagttccgacccggttcgtacggtccgacggtaccggaacgtcccgaccgttaccccgtacggtcctacgttccgtaccgttcccctcccgttcccg

SEQ ID NO: 58878 - DNA, 728 bp, Homo sapiens
  misc_feature: GYAE6OF02JN193.8.42.D09.1.454.CMB.1.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtccaccntcctcctgacaccgtggacgccagctagtgtaacttacaaactntaactctacctggtaaccaacgaaccaccagaccaaacgtacccccaactcatgtacttttagacgtacaacgtaacgcgtccctacgtacggggtacccgtcgtacttcgaccgttctacgacggcctaccgtaacgtctacgccaacgtaccggtcccttccgtacgtacccgtaccgtcgttccgggtacctaccgtacgtaccgtacggacggtacgtacgggaacggtcgtagttacgttaacttcggtaccgtacgtacgtaccgttactacttacgttacgacggtactacgaaccgtacggttacgggtaacggttccgggtaaccggtaacggggtaaccttaacgggttacgttacccggtacgttaccgggtacgtaacccggtaacgtacgggtacccgtcccgttacccgacggttccgttaccggtacccgtttcccgttccccggtcccgttaaccccgg

SEQ ID NO: 58879 - DNA, 746 bp, Homo sapiens
  misc_feature: GYAE6OF02INW1E.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatctcctgcactggacnccagcagtgattaacaactatactcctccgtggtaaccaacaacacccaggacaaacgccccaaactcatgtattttgaggtacaagtaacgcggtacctcgacgggtcctgtactcgtcttctcgacggcctaccgaagtccgtacggaccgaaacctaccgggtacccttacccgttacggacccgttccgttaccggtcggggtccctacccgtaagtaccgttacggaaggtacgtggacgggtacttacggtaactttaacgtttacgtacgtaccgtacgtaccttcgaacgtttacgttacgacggtactaacggacgtaacggtagggttacgttaccggggaccggggtaaacggtaaccgttaacgttaccggaaccgttaccggttaacgggttacccggtaacccggtaaccccggtaacgggtaccccgtacccggttacccccgttaccggtacccgttacccgttacccggtttacccggtttacccccctaccccgttaccccgg

SEQ ID NO: 58880 - DNA, 636 bp, Homo sapiens
  misc_feature: GYAE6OF02IG9XJ.8.42.D09.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacntcctctgcactggacgccagcagtgattacaactntatctctgtaccaacaaccaccaggaccaaacgccccaaactcattgtattttgaacggtacaaagtaacgccggtcctacgtacggggtaccctgactcgtccttctacgcggtctctaagtcgtgacaaccgaccggtcctaccgtcgtaccgtccgtacgtcggtaccgtccgacgtaccttaggacggtacttacggacggtctaggtattaacgttcgacgtaccgtggtacctacgttaacgtacttcgaggtactacggactaacgtagggtacgttcgggacgtaacggacacgttcgaccgtacgtaggtccgaacgccctaggtccgtaccgtccccgttcgtacctcccgttaccggtcccggttccccgtacccttcccgg

SEQ ID NO: 58881 - DNA, 643 bp, Homo sapiens
  misc_feature: GYAE6OF02H2HHW.8.42.D09.1.454.CMB.1.raw
  modified_base (224)..(224): a, c, t, g, unknown or other
  misc_feature (224)..(224): n is a, c, g, or t
  modified_base (485)..(485): a, c, t, g, unknown or other
  misc_feature (485)..(485): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacctatcctctgcactgganccagctagtagattaacaattatactctcctaggtaccaaacaaccaccgagaccaaacgacccccaatcatacgttatttagaggtacaacgtaacggccgtacccgtcgaccggggttccctgacgtccgtcttctacgcgtacctaccgtaagtcgtaggacctaacgaccgggtccctaccgtacgtacccgtctccggtcggtaccctaccgaggtacgtggaacggtcgtagacggtctagtaattacgtacgtnacgagtcctagtaattactacggagacgtactaacggaacgtagggtaacgtccgggacggtaacgggtaactacgggtacgttaccgtagtaccggtgaacggtccgaacgtcgaccgtcccgtcggtacctaccgtcgttccctcccgccgtaccg

SEQ ID NO: 58882 - DNA, 576 bp, Homo sapiens
  misc_feature: GYAE6OF02IBI8N.8.42.D09.1.454.CMB.1.raw
  modified_base (231)..(231): a, c, t, g, unknown or other
  misc_feature (231)..(231): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (516)..(516): a, c, t, g, unknown or other
  misc_feature (516)..(516): n is a, c, g, or t
tcagctcgcgtgtccacgaccggtgctcgatttagacacatacgcaggggaaagggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcacctatcctcctgccacgtggacnccagctagtgaattacaaactatactcctccttggtaaacccaaacaaccaacccgaacggaccaaaaccggtacccccaaactcaacttgtattttagagtacgtaataacggcgcctcgacgggtcctgacncgtctctcgcgacctacgtcncgacacacgcctaccncgacctctcgtcggctccgagtcngagatgngactgtatatactgcngctcatcngtcgcanacgtaagtggtagtcgggacgtacggacgacgtacgaccgtgtacgtcgacnccggtagcgtcccggacccgtcgtcctaccgttccgtcctacccgtacccgtcctaccgg

SEQ ID NO: 58883 - DNA, 736 bp, Homo sapiens
  misc_feature: GYAE6OF02GZ3AK.8.42.D09.1.454.CMB.1.raw
tcagctcgcgtgtccacgaccggtgctcgatttagacacatacgcagggaaagggggggtctcaggaggcagcgctctcaggacgtcaccacatggcctgggctctgctcctcctcaccctcctcactcagggcacgacgggtcctgggcccagtctgccctgactcagccctcctccggcgtccggtctccgtggacagtcagtcaccatcctcctgccagtggacgccaagcaagtcgtaattaccaaactatactcctcctacggtaaccaaacaaccaaccgacggaccgaaaccgaccccctaaactcaactacgttaacttttacggacggtactaaagtaaaccggccggtacccgtacggtacgggtcctagtaacgtcgtaccttcgtacggacgcctaccgtaacgtccgtaggacctaaccgtaccggtccttccgtacgtacccgtcgtaccgtcggtccgtaccgtaacgtcgtacggacgtacgtcggacggtctagtacttacgttacgtcgaactacgaccttacgtaacgttacgtacgacgacgtaacgaacgtaacgggttaccggtaacggttaccgggaccggtaacgggtaacgtaacgttacggaccgttacgtacgggtaacctaaccggacccgtaacgggtcctacccggtacccggtttacggtaccctaccggttcccttaaccggtttccccgacccgttaacccgg

SEQ ID NO: 58884 - DNA, 625 bp, Homo sapiens
  misc_feature: GYAE6OF02JEMAW.8.42.D09.1.454.CMB.1.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
tcagctcgcgtgtccacgaccggtgctcgatttagacacatacgcagggaaaggggggggtcgtcaggaggcagcgctctcaggacgtcaccaccatggcctgggctctgctcctcctcacctcctcactcaggcacagggtcctgggcccagtctgccctgactcagcctcctcgcgtccgggtctcctggacagtcagtccccatctcctgcactggacnccagcagtnaattacaactntactctctgaccaacaacaccagcaanccccaactcatacgtatttgagtactaataacgccgtcctacgacggtcctcgacgtcgtcttctcgacgtctactacgtcgtcgacaaccgaccgtcctacccgtcgtaccgtctccgtcggctaccgaacgtctaggagacgtcggacggtacgtagtacgtttactacgtacggctacgtctacgtacttaagttacacgtacgacggtaaccaacgtacgggttacgtacgggtacggtaacggtaactaacggttcgtaccgttaccgacggtaccgtacggacccggtaacggccctccggtaccccgtcgttaccgtacccttcgttacccgtccccgttacccgtacc

SEQ ID NO: 58885 - DNA, 806 bp, Homo sapiens
  misc_feature: GYAE6OF02HCPOE.8.42.D09.1.454.CMB.1.raw
  modified_base (230)..(230): a, c, t, g, unknown or other
  misc_feature (230)..(230): n is a, c, g, or t
  modified_base (692)..(692): a, c, t, g, unknown or other
  misc_feature (692)..(692): n is a, c, g, or t
tcagctcgcgtgtccacgaccggtgctcgatttagacacatacgcagggaaaggggggggtctcaggaggcagcgctctcaggacgtcaccaccatggcctgggctctgctcctctcaccctcctcactcgaggcacagggtcctgggcccagtctcgccctagactcacgcctccctcgcgtccgggtctcctggacagtcagtcaccatcctcctgactacgtggacnccagcagtcattacaacttatctctaccgtaggtaaccaacaaccaccaggaccaaaccgccccaactcatgtattttgacgtactaacgtagccggtaccctcggtacgggtccctagacgtccgttccttcgtaccgcggtacctaccgaacgttccgtacggactaaaccgtccgtcccgttacccggtacgtacccgttacgtccgggttacgggccctttacccgaaggtacccgttggggtaaacgggtaacgttcgggtaaacgggtcgtttaacggttaacgtttaaccgtttacgtaccgtacggttaacgtccttacttaaagtttcgttacggaccgggtactaacggtacccgtaacgggtaacgggtttaaccgtcccggggtaacggggaaacccggttcgtaaaaccgggtttccggaacccgtttacccggtaacggggttaaccncccggtaaaccccggtaagggttccccgacccccgggtttaacccccggttccggaaccggttaccccgttaaccggttttccccggttaccccccggtacccccttacccggg

SEQ ID NO: 58886 - DNA, 715 bp, Homo sapiens
  misc_feature: GYAE6OF02IFKC5.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtccaccatcctctgcacgtggacgccagcagtgacttaacaactatatcctactacggtaaccaaccaacctacccaaggaccaaaccgaccccaaactcaatcgtaactttttaggacgttacaagtaacgccgtcctacggtacgggtccctagtacgttcgtccttcgtacgacggtccctacgtaacgtcgtacggaacaaccgaaccggtcccctacccgtacggtacccgttcctccggttcggaccctaccgtaacggtaccgtaggtaacggtacgtaggtaacgtcgttaacgtaacgttttacgtaccgttcgacgttacgtaccgttaactaacttaagttccgaacggtactaccgaactaaacggtacgggttacgtacgggacgggtaacgtaacgtacggttacggtacccggttacgtacggtaccgacggtacccgtaacggtccgtaccgaccccgttacggtcctacgttcccgtacccgttaccccc

SEQ ID NO: 58887 - DNA, 572 bp, Homo sapiens
  misc_feature: GYAE6OF02F0SW1.8.42.D09.1.454.CMB.1.raw
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcagtgattacaactatatctacctgtaccaacaaccaccagacaacgaccccaaactcatntattttgaggtacaatacgcgacctcgacgggtcctgatcgcttcncagctcagtcngcacacgcctccngcctctcgtggcctcgagcgtgtaggntggagcgtagtaactttagtacngtcacgtctactattacgtcaggctagaccaaggtacggtagtccgggacggaacggtacctaaggttacgtaccgtaccgtacggtcgtaacggaccaacggtcccgtaccgtcccccgtggtccctaccgttccgttacccgttccccacccgtacccg

SEQ ID NO: 58888 - DNA, 770 bp, Homo sapiens
  misc_feature: GYAE6OF02HZG3M.8.42.D09.1.454.CMB.1.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (287)..(287): a, c, t, g, unknown or other
  misc_feature (287)..(287): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaactatatctctgtaccacaacaccagacaacgaccccaaatcatntattttgagtacaataagcggcctcgagggtccctgatccgtcttccgtgacgtcctacgtaagtcgtcggtaactaaccgacgggtccctcccgtaggtaccccgttcgttccgtacggggtaccctaccgacgtaccgttacggaacgggtacgttaggacggtacgttacgtaacgttttaactttacgtacggtaccgtaacggttaccttacgtaaacgttaacgtttcggtaacggttaccgaaacgggtaacccgtaaaacggttaacggggtttaacggtttaaccgggggaccgggtaaaggggttaaccccgtaagggtttacccggtaacccgggttacccggtttaaacgggtacccggtaaccgggtaacccccgttaaacggggtccccggttacccggttacccccccggttaccgggttacccccggttaaccctttcccccgggtttacccgtttaccccccccgg

SEQ ID NO: 58889 - DNA, 684 bp, Homo sapiens
  misc_feature: GYAE6OF02GE6V1.8.42.D09.1.454.CMB.1.raw
  modified_base (367)..(367): a, c, t, g, unknown or other
  misc_feature (367)..(367): n is a, c, g, or t
tcagctcgcgtgtccacgaccggtgctcgatttagacacatacgcagggaaagggggggggtctcaggaggcagcgctctcaggacgtcaccaccatggcctggctctgctcctcctcaccctcctcactcagggcacagggtcctgggcccagtctcgccctgactcacgccctccctccgcggtccggtctccgtggacagtcagtcaccatctcctgcactggacgaccagcagtgacttaacaactatactcctccgtacgtaaccaacaaccaccgacgacaaccgacccaactcatagtactttgacgtacaagtacggaccgtccgtacgaccgggtcctagtacgtcctcttcgtaccncggtacctaccgtagtccgtacggacctaaccgacccgtccctacccgtacgtacccgttcgtcggtcggtacctaccgagacgtacggaggtacgtaggtacgtcgtacgttagttacttactaccgtactacgtcttactagttaactcgtaacgcgaacgtaccgtaacggtacgggttacggtaccgggaacgggtaacggtaaccgtaaggttacccgtaccggtaccgtacggtaccgaccgtacccgtacgcccgtacccgtccccgtacgtccgtaccgttcccgtacccgttcccacccgttacccgg

SEQ ID NO: 58890 - DNA, 669 bp, Homo sapiens
  misc_feature: GYAE6OF02GHDOF.8.42.D09.1.454.CMB.1.raw
  modified_base (248)..(248): a, c, t, g, unknown or other
  misc_feature (248)..(248): n is a, c, g, or t
  modified_base (522)..(522): a, c, t, g, unknown or other
  misc_feature (522)..(522): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagccctccgtccgcgtccgggtctcctggacagtcagtcaccatctcctgcactggacgccagcaggtgattaacaactntactccgtcctacggtaccaaacgaaccaacccgaggaccaaaccgaccccaaactacacgtatacttttggacgtacgaaatacggcgacccgtgcgggtacccgtctacgtcgtacttcgtacgacgtcctaccgtagtctcgggacaacctccggcctccgtacgaccgttccgtcgtacggtccctccgtaacgaccgtggaacggatacgggtacgtacgtcgtaacgttacgttaccgtacgtagacgtacctactacttagtaccgngtacgaactcgtaacgtagggttcgtacgggaacgggtaacgtaccgtaagtccgtacggtccgtaggtaccgcggtaaccgacgttaccggtacccgtcccgttacggtaccttcccgtacgttacccgtaccctcccgtacccgg

SEQ ID NO: 58891 - DNA, 909 bp, Homo sapiens
  misc_feature: GYAE6OF02IX8ZT.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcgacgggcacgagggtcctgggacccagtctcgccctgactcacgtccctcccgtccgcggtccgggtctcctggacagtcagtccaccatctccgtgcacgtggacgccagctagtacgtaacttacaactatactctaccttacggtaaccaacaaccaacccgacggacaaaaccgaccccctaaacgctaagtacgttagtttttacggaacggttaacaaacggtacggcccggtacccttaccgggtaccggggttccctaggaccttccggtacctttaccgacgtacggtaccctaaccgtacggtcctaccgggaacctaaccggcccgtacccgttcccgacggttacccgtcttccggacggtcctacgtacgtaccggtggtaacggtacgtacgggacggttacgttacgggtaaactttaccgggtaacgttacggaccgtaacggttacccgtttaacgttaacgtttaaacgtttcccgggaaacggaccggttaaccgggttaaacccgtaaaccggggtttaaacgggggtttacccggttaacccgggggaaacgggggttaaaccccggggttaaaaaccgttaccggggttaaacccgggtttacccggtaacccgggttttaacgggtaacccggtaacccgggtaacccgtaaccgggggttccccttaaccccgggtacccccggttacgttaaccccggttaaccccggtttaccccttacccgggtttaccccccctacccgttacccccggg

SEQ ID NO: 58892 - DNA, 745 bp, Homo sapiens
  misc_feature: GYAE6OF02IEQ9B.8.42.D09.1.454.CMB.1.raw
  modified_base (238)..(238): a, c, t, g, unknown or other
  misc_feature (238)..(238): n is a, c, g, or t
  modified_base (393)..(393): a, c, t, g, unknown or other
  misc_feature (393)..(393): n is a, c, g, or t
  modified_base (631)..(631): a, c, t, g, unknown or other
  misc_feature (631)..(631): n is a, c, g, or t
tcagctcgcgtgtccacgaccggtgctcgatttagacacatacgcaggggaaagggggggggtctcagggaggcagcgctctcgaggacgtcaccaccatcggcctgggctctgctcctcctcaccctctcactcgagggcacgcgggttccgtcgggcccaggtctcgccctagactcacgtccctccctcggcgtccgggtctcgtagacagttcacgtccactatcctctcgacncgtacggcaccagcagtataacttaacaactatactccgtacgtaccgtaacaaaccaccgaccgaacggaaccaaaccacccctaatctatcggttaagttttcgaacggtactaaaggtaccggaccgtccgttacgggaccgggtcttaacncgttccgtactttccgagtaccgtacctacggtcctacggtaccggtaaccaccgtacccggttccctaccggtcggtacccgttcgtccgggtccggtacctacggtcgaacggtcgggtaatgggtacgtaccgtgttaacgtacttacgacgtagtccaacgtgttacctagtcgtaccgaggaaccgtcgaacgaacggtcgggttacgaagggtccggaaacggttaacggtnaccggttaccggtaccgtacgggtacctaaccgggtaccctaggggttccccaccggttcccgttaccggactttacccggttaccccgttccgacccccggtttaccacccgg

SEQ ID NO: 58893 - DNA, 701 bp, Homo sapiens
  misc_feature: GYAE6OF02HO5H4.8.42.D09.1.454.CMB.1.raw
  modified_base (569)..(569): a, c, t, g, unknown or other
  misc_feature (569)..(569): n is a, c, g, or t
tcagctcgcgtgtccacgaccggtgctcgatttagacacatacgcagggaaagggggctggggtctcagggaggcagcgctctcaggacgtcaccaccatggcctgggctctgctcctcctcaccctcctcactcgagggcacacgggtcctcgggcccagtctcgcccgtgaactcacgccctcccgtccgccgtccgggtctcctggactagtcacgtccactactcctcctagcctacgtggacgtaccgagacgtagtacgtaactttaaccaaaacttactaaccttccttaccgttacgtaaacccaaacgaaaccaccaacggaaccaaaccgtaacccccaaactacacgttagttaacgttttacgaacggtacaagtaacggccgtccgtacggtacgggtacctagacgtacgtccttacgtacgacggtacctacgtaagtcgtacgacgtaaccgaccgtacctccgtacgtaccgtccgtcgtcggacctacacgcgtaggtagacgtagacgtactacgtagttactagtacgcgtactacgtactacttacgngaacgtacacgtaacacggtacggttacggttcgggacggaacggtaccgtacgttaccgacgttacggtaactcgaaccggccgtaaccgtcgtaccggcccgttcgtacctacggtccctaccggtcccg

SEQ ID NO: 58894 - DNA, 612 bp, Homo sapiens
  misc_feature: GYAE6OF02H730P.8.42.D09.1.454.CMB.1.raw
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (459)..(459): a, c, t, g, unknown or other
  misc_feature (459)..(459): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcacgcctccctccgcgtcccgggtctcctggacagtcagtcaccatcctctgcactggacgccagcagtgattacaacttatactctctcgtaaccaacaaccaccaggacaaacgccccaaatcatntatttgagtacaagtacgcgtccngacgggtcctagactcgtcttcncgtacgtctacgtaagtctcggacaacgaccggtccctacccgtcgtaccgttctccgtcgggcctaccgagtacgtcggaaggtcgtaggaacgtcttaagtaactttacgttacngtaccagtcttacaagttctacgaagcacgtacgaacgtaggttcgtacgggacggtacggaacctaaggttccgaccgttacgtacgaccgtacgaccgtacggccttcccgcccgttacgcctacctcccgttcctccccgtaccgtcccg

SEQ ID NO: 58895 - DNA, 790 bp, Homo sapiens
  misc_feature: GYAE6OF02IYG5W.8.42.D09.1.454.CMB.1.raw
  modified_base (238)..(238): a, c, t, g, unknown or other
  misc_feature (238)..(238): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggctacgagggtcctgggcccagtctcgccctgactcagccctccctccgcgtccgggtctcgtggactagtcagtccaccatccgtcctgaccaccgtgggacnccgagccgtaaaggtcgtaattttaaccaaacttaagttaccttacgttcccgttacggtaacccaaaaccaaccgaaccccaagggaaaccctaaaaccggaccccccaaaaacgtcctagtacggtttaactttttaccggaaaggttaaccaaaacggttaaaccggcccggtaccctaccggttacggggtacccccttaggaacgttccgttaccttcgtcgtacggtcctaaccgtacgtcgtacgctaacccgacggtccctccgtacgaccgtctccgtcggtcctacgacgtagtacgagtagtacggacgccgttagtaactttacgtacgtcgctaaacggtccttacgtaagttaccgttaacggcggacgaactaaccggtagtaaccgggttacgttcccggggaacggtaacggacctaaacgggtttcgacccgtacggttaccgtacgtaacccgtaccgggaacttccggtccctaaccccggttccggtaccttacccgttccggtccctttacccccggtcccgttacccgg

SEQ ID NO: 58896 - DNA, 780 bp, Homo sapiens
  misc_feature: GYAE6OF02FT958.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagccctcctccgcgtccggtctcctggacagtcacgtcaccatcctcctgcacgtggacgccagcaggtgacttaacaacttatactcctccgtagtaacccaacaaccaccagaccaaccgaccccaatcatagtattttgaggtacaagtaacggccgccctcggacgggtccctagtactccgtcttcgaccgtacggtaccctaccgtaacgttcgtacggacctaacgtacgtccggtaccccgttccccgttaccgtacccgttccgtaccggttccggggtcccttacccggaaccgtaaccggtacgggtaaggtacgttacgggacggttaccgttaaggttaacttttaaccgtaccgttccggtaacgtaccggttcctttaaccgttagtttacgtttcggaacggtacgtacgtaaccggtaaacgggttacgggttaccggtacggggtaaccgggtaaccggtaaacgttacgggttacccggtaccgggttccggtaaccggtccggtaaccggaacccggtacggtccccgttaccccggtaccccgttcggtacccgtacccgttcccgttacccggttccccgttaacccccg

SEQ ID NO: 58897 - DNA, 501 bp, Homo sapiens
  misc_feature: GYAE6OF02FK0QM.8.42.D09.1.454.CMB.1.raw
  modified_base (467)..(468): a, c, t, g, unknown or other
  misc_feature (467)..(468): n is a, c, g, or t
  modified_base (470)..(470): a, c, t, g, unknown or other
  misc_feature (470)..(470): n is a, c, g, or t
  modified_base (472)..(501): a, c, t, g, unknown or other
  misc_feature (472)..(501): n is a, c, g, or t
tcagctcgcgtgtccacgaccggtgctcgatttagacacatacgcagggaaaggggctggagtgggtctcagttatttatcgcgatggtggcacacactacgcagactccgtgaagggcagattcaccgtctccagagacaattccaagaacatggtgtatcttcaaatgaacagactaacagccgaggacacggccgtatattactgtgcgagacatgactacggtgacgccctggggccacgggaaccctggtccaccgtctcctcagcctccaccaacgggcccagtcggtccttcccccgtggccgccccgtgctcccgaggacgccacctccggagacgcacgcgccggccctggggcctcgcccgtgggtacaacgggtacctaccgttcccgaacgaccgacggacgccgttcggaacggccggggtccgtcgggacaaacggggccgtacgaatacggnngngnnnnnnnnnnnnnnnnnnnnnnnnnnnnnn

SEQ ID NO: 58898 - DNA, 418 bp, Homo sapiens
  misc_feature: GYAE6OF02FQN3J.8.42.D09.1.454.CMB.1.raw
  modified_base (396)..(396): a, c, t, g, unknown or other
  misc_feature (396)..(396): n is a, c, g, or t
  modified_base (402)..(418): a, c, t, g, unknown or other
  misc_feature (402)..(418): n is a, c, g, or t
tcagctcgcgtgtccacgaccggtgctcgatttagacacatacgcagggaaagggggctggagtgggtctcagttatttatcgcgatggtggcacacactacgcagactccgtgaagggcagattcaccgtctccagagacaattccaagaacatggtgtatcttcaaatgaacagactaacagccgaggacacggccgtatattactgtgcgagacatgactacggtgagcctggggccagggaaccctggtcaccgtctcctcagcctccaccaaggccccatcggtcttccccctggcgccctgctccaggagcacctccgagacgcaccagcggccctgggctgcctggtcaaggctacttccgacacgcgagctgagcgggctggcaggcncatagnnnnnnnnnnnnnnnnn

SEQ ID NO: 58899 - DNA, 754 bp, Homo sapiens
  misc_feature: GYAE6OF02HM0RJ.8.42.D09.1.454.CMB.1.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgccgtccgggtctccgtggacacgtcagtcaccatcctcctnccatggacnccagcagtcattacaatatactctcctagtacaacaacacccgagaccaaaccnccccaaacgtcaatcgttagttttacgacggtactaaagtaacggccggtacccgtcggtacgggtccttagactaccgtcttcgtcgacgcctaccgatacgtggaccaacgtaccgtcctccgtacacccgttctacggtcggtaccttcgaacgtcgtaggtaacggtacgtacggtacggtaccgtagtttaaacgtttacgttaccgtacgtaccgtacgtacctcgtttaaacttacgttaccgacggttaccgaacggtaaccgtaaaccgggttaacggggtttccggtaaccggggtaacgggtaccggtaaaacgggttaaccgttacccgggttaccttacccgggtaacggttacccgtaaccgggaaccccggtaacggcccgtttacccggtaccccccgttaggttacccctaccgttaccccgtttaccgttaccccccggtaccttaccccggg

SEQ ID NO: 58900 - DNA, 707 bp, Homo sapiens
  misc_feature: GYAE6OF02GWECZ.8.42.D09.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagctcgcgtgtccacgaccggtgctcgatttagacacatacgcaggggaaagggggggggtctcaggaggcagcgctctcaggacgtcaccaccatggcctgggctctgctcctcctcaccctcctcactcgagggcacgagggtcctgggcccagtctcgccctgacctcacgccctccctccgcggtccgggtctccgtggacagtcagtcacctntcctctgcagtggacgccagcagtnattacaatntntctctacgtaccaacaccaccgacgacaaaccgccccaactcatcgtatttacggaggtacaagtacgccgaccctacggaccgggttcctagtacncgtccttntaccgtacggtcctaccgtaagtccgtaggaccaacgtacccggtccctacccgttacgaccgttcctaccgggtcggtaccctacgtacgacgtacggacggtacgtacggtacggtacttacggaacgttttttacaccgttacgtacctacggtcttaactagtttacgtacgtacggtaccaacggttacgaacggtaacgggttcggtaaccgggtcgggaaccgggtaccgtaacggttaccgtaccggtaccggtaccgtaccggcgtaaccgtaccggtccgacccgtcccgtacgtacccgtaccgttacccgtaccgtccccgtacccgtacccgg

SEQ ID NO: 58901 - DNA, 893 bp, Homo sapiens
  misc_feature: GYAE6OF02GMS4U.8.42.D09.1.454.CMB.1.raw
  modified_base (207)..(207): a, c, t, g, unknown or other
  misc_feature (207)..(207): n is a, c, g, or t
tcagctcgcgtgtccacgaccggtgctcgatttagacacatacgcagggaaaggggggggtctcgaggaggcagcgctctcaggacgtcaccaccatggcctgggctctgctcctcctcaccctcctcactcagggcacagggtccctggacccagtctgccctagacctcagccctccctcggccgttccgggtctaccgtggacncggttccaggtccaaccatcctcctggacctagtcgggactcccaggcctaagggttcaactttaaccaaacgtttagtacgttcccttacccgttacggttaaacccaaaccttaacccgaaacccgtaaccgggaacctaaacccggaacccctaaaaccgttaccgaacttacgttaacgttttacgtaacggtactaaagttaacggaccggtaccctaccggttaacgggtaccccgtagtaacgttccggtaccttacccggtcgtaacggtcctacgtaacgtccggttacgaccgttaaccgacggtccgtccgtacgtaccgttccgtaccgtttcggaccgtaccgaacgtaccggtaacggtaacggtacgtacggtacggtacgttacgttaaacgttacgtttacgacgtccggttaacgaccttacgtaacgttaacgtttaccggaacgggttctaaacccggataaacccggggttggtaacccggttacgggtaccgggtaaaccgggtaaccggttaaacggtttacgggaacccgtttacccggtaaggtacccgggtaaccggtacccggtaaaccgggtcccgttaacccggttaccccggtaccgggtttacccgtaacccggttttccgtaccccggtttaccccggtacccggttaccccgg

SEQ ID NO: 58902 - DNA, 773 bp, Homo sapiens
  misc_feature: GYAE6OF02G1C09.8.42.D09.1.454.CMB.1.raw
  modified_base (344)..(344): a, c, t, g, unknown or other
  misc_feature (344)..(344): n is a, c, g, or t
tcagctcgcgtgtccacgaccggtgctcgatttagacacatacgcagggaaaggggtgggagaggagcccagcactgggattccgaggtgtgtccattcggtgatcagcactgaacacagaggactcaccatggagttctggctgggcttgggttttccttgttgctaatttcaaaggtgtccagtgtgaggtgcagctggtggagaagtgggagggggcttgatccgagggccggggggtcctgacgctctcgtgtgcgcgcctgtggcttcaccatcagtagagaactacagtggagcgtcgggcccaccggacggcctaccggaaggggagggcgtagggnggtcgggtctacgtagtttacgtttagcgacgtgtgggtacgaccaacgtacaacgtcgactaacggtacccgttaccggtaagggaacgggacgaacggttaccgttaccgtaccccggttacctaccggtacgggaactaaaccttaaaccgtaccgaaaacgaaacgttaacggtttacgggttacttaaccgttttaaccgttaacgtaaaacgttaaccgaaacgttaaaaccgtaaacccgttaaacggtaaccgggacccggtaaaccgggacccggtaacgggttaaccgttaacgtttaacggtttaacgtagggttaaccggtaacgggaaggttaaaccctaggttaccggtaaaccggtttaccgggtagggaaccccgggtttccccggggaggggtaaccccggggtaacccggg

SEQ ID NO: 58903 - DNA, 739 bp, Homo sapiens
  misc_feature: GYAE6OF02I7KVG.8.42.D09.1.454.CMB.1.raw
  modified_base (229)..(229): a, c, t, g, unknown or other
  misc_feature (229)..(229): n is a, c, g, or t
  modified_base (396)..(396): a, c, t, g, unknown or other
  misc_feature (396)..(396): n is a, c, g, or t
  modified_base (465)..(465): a, c, t, g, unknown or other
  misc_feature (465)..(465): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcaggcacagggtcctcgggcccagtctgccctgactcagcctccctccgcgtccgggtctccgtggacagtcagtccaccatcctctgcacgtggacnccagctagtgaactaccaactatactccttaccgtgtaacccaacaccacccgaggacaaaccgacccccgaaactcatacgttagttttacgacggtacaacggtaacggcccgtccgtacggccgggttaccctaggactcgtcttactcgacggcctaccgtancgtaccgacgaaccgtccggtccttaccgacggtacccgttcgtccgttcgggacctaccgtggtacgnggtacggtaacgtggacgtcttaagttacgttaaccgtttacgaccgtccgtaatcgtaactactacgtaccgaacggccttaacggaaccggtaaggtacggtttacgggtacggggtaccgggtaaacggtaacccgttggttaacccgttaccggtaaccggtttaccgggaccgtaaccgggtaaccgtacgttaccccggtaaccccgttcccgggtaacccgttcccgtaaccgtttccccggaccccgttacccggtaccttacccg

SEQ ID NO: 58904 - DNA, 785 bp, Homo sapiens
  misc_feature: GYAE6OF02GN36C.8.42.D09.1.454.CMB.1.raw
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatcctcctgcactggacgccagcagtgacttacaatatactctctacggtaccaacaaccaccaggacaaacgacccccaaactcatagtatttttaggacggttactaaagtaacggccggtacccgtaccggtacgggggttcccctaggtacttccgtaccgtttctaccgacggtccttaccgtaaacggttccgtacgggaacctaaccgtaccccgggacccttccccggtacgtacccgttccgttaccggtccgggtacctaccgtacggtaaccgtaggaacgggtacgtagggtacggtcttaagtaactttacgttaaccgtcggtacgtacggtacttacgtaacttacgttacgaacggtcgaaccgtaacggtaaaccgtaggggttaccgttaccgggacgggtaacggtaaaccgtaagggtttacccgtaacccgttaccgtttaacggtacccgtaaccggtacccgtaaccgggtacccttacccggtacccccggttacggtacccgttaccggtttacccctttacccggttacccccgtaccccttaaccccgg

SEQ ID NO: 58905 - DNA, 751 bp, Homo sapiens
  misc_feature: GYAE6OF02JZUDM.8.42.D09.1.454.CMB.1.raw
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
tcagctcgcgtgtccacgaccggtgctcgatttagacacatacgcagggaaaggggggggtcgtcgaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcacatctcctagcactggacgccagcagtgaacttacgaacttanacttctcctcggtaccaacaacaccaggaccaacgaccccaaactcatgtattttacgagtacgaataacggccggacctcggacgggtcccagacgtgtccttcgtcaggtaccacaagttccgacggtcaacacccgggtccctccgtaccgtacccgttgttcccggtacggtacccgttaccacggtaaccggtaggacgggtttacgtcggtaacggtacgttagtaacggtttactttaacgtagtccgtaacggtaccttacgtacttaaccgtagtaaccggccaaccggtacgtaaacgggttaacgggttacggtacgggttaacccgggggaacgggtaaacgtaaccgggttaacgtacccggtaccggttaacgggtcccgtaacggtacccggtaaccgggtcccgttcccccgggtaacccgtttccccgggtaacccttacccgttaacccgtttcccggttcccccgaacccccggtttccccc

SEQ ID NO: 58906 - DNA, 788 bp, Homo sapiens
  misc_feature: GYAE6OF02I1LMA.8.42.D09.1.454.CMB.1.raw
tcagctcgcgtgtccacgaccggtgctcgatttagacacatacgcagggaaaggggggggtctcaggaggcagcgctctcaggacgtcaccaccatggctgggctctgctcctcctccaccctcctcacttagggcacagggtcctgggcccagtcctcgccctgactcacgccctccctcgcgtccgggtctccgtggacagtcagtccacctatctcctgctactggagccagcctagtcgaacttaacaacgttatattcctaccgtacgtaaccaaacaaccaacccaggaaccaaccgaccccctaaaactctaatacgttactttttaggaacgtactaaacgtaaggaccggtcccgtacggtaccggggtccctgtactccgtcttcctcgtacgtcctaccgtaagttccgtaggaaccaaccgtaccggtcccaccgttacgtacccgtcgtcccggtcggtcgtacccaacggtcgtaggtaacggtacgtacgggtagtccgtaacggttattaacgttaccgtcgtacgtacgtacgttacgttattacttaacgaccggtacgtaaccgactaaaccgggttacggtaaccggtccgggtaaccggggtaacggtaaccggttaaacgggttccgttaaccggtaccgtttaccgggaacctacccgggaccggtaaaccgggtcccgtaacccggttaccccgttacggtacccgttacccgttacccgggtttcccgtaacccccgggttaccgtttaccccggtaacccgg

SEQ ID NO: 58907 - DNA, 705 bp, Homo sapiens
  misc_feature: GYAE6OF02FMPA0.8.42.D09.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgattacaactntactctctgtaccaacaacaccagacaacgcccccaactcatgtattttagagtacaataagcgtccctcgacgggtccctgtactcgtcttctacacgctaccaagtcgtcggaccaaccgaccggcccttccctacgtacccgtccgtaccgtcgggtccctaccgtacgtaccgtggaacggtacgtacggtacggtccgttagttaactttaacgttaccgtcgtcgtaacggtccttaccgtaattacctttacgacggtacgtaacggtaccaaacggtacgggttaccgttacggggaccgggaacgggttaaccgtaacggttaccggtacccggttaccgtacgggtaccgaaccggtacccgtaacgggtcccgtacccggtacccccggttccggttacccgttaacccgttcccggtacccgtttaccccccgtaccccgttaccccgg

SEQ ID NO: 58908 - DNA, 824 bp, Homo sapiens
  misc_feature: GYAE6OF02JN5RH.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacgacgggtcctgggcccagtctcgccctgactcagcctccctccgcgtccgggtcctccgtggacagtcagtccacctattcctcctgcacgtggacgccagctagtgacttaaccaacttagacttcctaccttacggtaaccctaaaccaaacccgaccccgacgggtaacccaaaacccggtacccccctaaaactcgtaagttacgtttagtttttcggaacggtacctaaaacgttaacggtccccggtacccgttaccgggtaaccggggttaccccttgggtaaccgttccgttccgttccgtaccggtaccggtacccttaacccggtaacgttccgtacgggtacccaaaaccggtcccggtaccccgtacccgttacgtacccggttccgtacggttcgggtacctaccgtacggtaccgtagggtaaccgcgttacggtacggtcgttagttaaccgttagtaccgtacgtaccgtacgtctaacgtacttaccggttacgacggaaccaaccggtaccgtaaacggttaacgggttcggttaccgggacgggttaaccgggtaacgttaacggttaccgaccggttcggtaaccggtaccgccggtaaccgaccggtaccgttcccggtccccgttacggacggttacccgttaccgttacccggtaccccg

SEQ ID NO: 58909 - DNA, 779 bp, Homo sapiens
  misc_feature: GYAE6OF02JX8MW.8.42.D09.1.454.CMB.1.raw
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctctcactcaggcacacgggtcctcgggcccagtctcgccctgacctcgacgcccttcccgtccggcggttcccgggttcctccgtggacctaggtcacgtccaaccgtcttcctccgtagcaccgtgggacnccagctagtntaacttacaactatactcctcctagtaaccaacaaccaccgtaggaccaaccgacccctaatacagtagttactttaggacgtacgaactacggccgtcctacgacgggtccctagctcgtacgtccgtcgacgtcctaacgtacggtacgtacgaccaaccgtccggcccgttaccgtacggtacccgttccgtacgggccggtacgtacctaacgggtacgtacggacgggtacggttccggacggttacgttaacgttacgttaacgttaccggtacgccgtaaacgttcgttaacctacggtttacgaccggtaaggtaccgtaacgtaaccggtagggtttaaacggggtcgttaccggggacgggtaacggtaaccggtaacgggttacgtacccgtaccgggttaacgaccgtacccggtaacccggttaaggcccccggttacctcccggttaacccgtcgttaaccccggttccgtttcccccggttacccgtccccttacccgg

SEQ ID NO: 58910 - DNA, 807 bp, Homo sapiens
  misc_feature: GYAE6OF02JUOAN.8.42.D09.1.454.CMB.1.raw
  modified_base (253)..(253): a, c, t, g, unknown or other
  misc_feature (253)..(253): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcaccagggcctgggcccagtctgccctgactcagcctcccgtccgcgtccgggtctcctggacagtcagtccaccatcctccgtgcacgtggacgccctagcagtgattaccaaactntactcgtacctcggtaaccaaccaacctacccaacgggtaccaaaaccggaccccctaaaactgtaactacgttagtttttaggaacggttacctaaaagtaaccgtacccggtacccgtaccggttacggggtaccccttggaaccgttcggttaccttcgtaccgacggtctacccgaagttccgtaccgacaacccgtcgacccgttccgtcgtacccgtcgtcggccggtccgtaccgacgacgtaggtaggtactggacgtcgtaatacgtttaacggtctagggtctaaccgtcgtttaagaccgtttagtacccgagggacgtaacgtacccgtaaaggtaccgggtttcgttacccgggggaaacggtaacgggttaaacccgttaaagttaacccgggtttcccgttaacccggtaggggtccccgtaaacgggttaccccgtaacggggtaacccccttccccggtttaaccccccggtggttaacccggtaccccgttttacccgggttacccctttacccccgggtcccccgtttaacccgg

SEQ ID NO: 58911 - DNA, 653 bp, Homo sapiens
  misc_feature: GYAE6OF02JM88A.8.42.D09.1.454.CMB.1.raw
  modified_base (232)..(232): a, c, t, g, unknown or other
  misc_feature (232)..(232): n is a, c, g, or t
  modified_base (328)..(328): a, c, t, g, unknown or other
  misc_feature (328)..(328): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (644)..(644): a, c, t, g, unknown or other
  misc_feature (644)..(644): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcgagggcacgagggtcctgggcccagtctcgccctgactcagccctccctccgcgtccgggtctccgtggacagtcagtcaccatcctcctgcacgtggacnccagacagtgtacttaacaactatactcctccgtacggtaaccaacaaccacccagaccgaaccgaccccaaactcatgtattttagagtactaanaacgccgaccgtcgacgggtccagtacgtcgtcttacncgacgtcctacgtacgtcgtcgacaacnccggaccctaccgtcgtccgtacgtcggtcggtcctacgtacgtacgtagacggtagtacggacgtaccgtgttaacgttacttacgtacgaccgttagtactacgttactacgtacgacgtaccgaagtaccgtaaggtaggttacggtccggacggtaagggtactaacgtcggtacccgtagtaccgtacgccgaccgtacgtcccgtaccgcccgttaccggcctaccgttccgacccgttacccncccgtaccg

SEQ ID NO: 58912 - DNA, 871 bp, Homo sapiens
  misc_feature: GYAE6OF02FVZL3.8.42.D09.1.454.CMB.1.raw
  modified_base (244)..(244): a, c, t, g, unknown or other
  misc_feature (244)..(244): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagccctccctccgcgtccggtctccgtggacagtcagtcaccatctcctgcactggagccagcagtgattacaatntctctctgtaccaacaacaccaggacaacgacccccaaactcatgtatttttacgaggttacaataacggccggtcccgtacgacgggtcccctaggtactccgtcctttacgtacgtacggtcctaccgtaagttcgtcggacctaaccgaccggtacccgttacccgtacggtacccgttccgtccgtcggggtaccctacccgtacgtaccgttaggaaccgggtagtacgggacgggtcgttaggttaactttaacgttacgtacggtaccgtaacggtaccgttacttaacgttaacgtttaccgtacgggaacccgttaagggtaaccgttaaacccggggttaaggggtttaacccgggttaacccggggggtaacggggttaaaccggggttaaacccggttaaacggggttttaccccgggtaaccccgggtttaacccggtttaaccggggtaacccgggttaaaccccgggtaaccccggttaaaccggggttccccggttaaccccccgggtcccccggttttaaccccggttacccccgggtttaaacccccgttttccccgggtttaccccccggttacccccccgggtttacccccgtttaaccccccgggg

SEQ ID NO: 58913 - DNA, 735 bp, Homo sapiens
  misc_feature: GYAE6OF02GGGXX.8.42.D09.1.454.CMB.1.raw
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacactatatctctgtaccaacaaccaccagcaaacgcccccaactcatgtattttgagttcaataagcgccctcgacgggtccctgatcgcttcncacggctaccaacgttcncggacaacgtacggaccctcccgtcgtaacccgtcttccgtcgggtcctcctaacgctaggtaggaacgttggaacggttcctagtaagtttaaccgttactcggtaccacggtaccttactaaagtttacgttaccgtaggaccgttaaacggaccgtaaacggtaacgggggtttaaccgttccggggggtaaccggggtaaccgggtaaacccgttaaagggttaccggtaaccccgggtttaccggtacggtaaccggttaacccgggaaccccggtaaacgggtccccggttaaccccggttccccccggttccggttaccccgtacccgtttaccccggtttaccccgttttaccccccccgtaccccgtttccccccgg

SEQ ID NO: 58914 - DNA, 807 bp, Homo sapiens
  misc_feature: GYAE6OF02GOZ9P.8.42.D09.1.454.CMB.1.raw
  modified_base (246)..(246): a, c, t, g, unknown or other
  misc_feature (246)..(246): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcgagggcacgagggtcctcgggccctaagtctgccctgacctcacgccctcccttccgccgtccgggtcctccgtggaccagtcagtcacctactcctccgtagccacgtggacnccaagccgtagttagtaacgtttaaccaacttacgtatcccttccgttacggtaaacccaaaccaaccacccgacggtaaccaaaccccgtaaccccaaacttcaatacgtttacgtttttacggaacggttactaaacgttaacggcccggaccccgttaccggtcggggttacccctaggtaccgttccgttccttcccgtacgtaacggtcccttaccgtaacggttccgtacggggaacctaaaccccgggtacccgtcccctttaacccggtaccgtaccccgggtttccttacccgggttcggggtacccctacgtacgggaccgttacggtaacgtacgtacggaccgttgtaaacggttactttaaacgtttcgacgtacgtaactcgtttacttactttacgtaccgaggtaccgaacgttaccgaaacggttacgtacggttacccgggaacggtcggtaaccgtagttaccgtccgttacgtagtccggaaccgtaccgacggtccgttccgacccgtggtcctcccgttcgtcccgtccgaccctccgg

SEQ ID NO: 58915 - DNA, 587 bp, Homo sapiens
  misc_feature: GYAE6OF02IK6ZZ.8.42.D09.1.454.CMB.1.raw
  modified_base (346)..(346): a, c, t, g, unknown or other
  misc_feature (346)..(346): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagcctccctccgcgtcccgggtctccgtggacagtcacgtccaccatcctcctgcacgtggacgccagcagtgattacaactatactctcctagtaaccaacaacaccgagacaaaccgaccccaatcatgtattttgagtcaatacgcgtcctcgacgggtcctagactcgtcttcncgacgtcctaccgaagtctacggaccaaccgacgtccctcccgtcgtaccctcgtaccgtcggcctacgacgacgtaggacggataggagtcgtagtattacgttacgtgcctagtctctagttactcgacgtcacgacgtaacgtggtacggtcggacgacgacgtaacgtcgacctcgtacgtcgacgtaccaggtcctcccgccgtcggtactccgttcgtaccttccccaccgtccg

SEQ ID NO: 58916 - DNA, 654 bp, Homo sapiens
  misc_feature: GYAE6OF02FN7CS.8.42.D09.1.454.CMB.1.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (334)..(334): a, c, t, g, unknown or other
  misc_feature (334)..(334): n is a, c, g, or t
  modified_base (473)..(473): a, c, t, g, unknown or other
  misc_feature (473)..(473): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcagggcacagggtcctgggcccagtctgccctgactcagtccctcccgtccgcgtcccgggttctcctggacagtcaagtcaccactctccgtgctacgtggaagccaagcagtnacttacaactatntctctcgtacaactaacaccagacaaccgaccccaactcactagtattttagacgtcaatagccgcctgacggtccngtactcgtcttcacagtcctacgtacgtctagacaacgcgccttccgacgtaccgtcgtacgtcggtactccgacgtacgtaggacgatggtacgtctagtaacttactacgtcgacgtcgtactcgtattaacgtcgnggtaaccgaagtaccgtaaaggtacgggttacggttccggggttaacggaaccggtaaccgtaaacgggtttccgtacccgttacgtacgggtaccgaaccgtacccgggtaacgcccgtacccggtaccccgtacggtccttaaccgtcccgttacccggttacccctcccgtaacccgg

SEQ ID NO: 58917 - DNA, 627 bp, Homo sapiens
  misc_feature: GYAE6OF02F2XJ6.8.42.D09.1.454.CMB.1.raw
  modified_base (226)..(226): a, c, t, g, unknown or other
  misc_feature (226)..(226): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctccgtggacagtccagtcaccatctcctgcagtggacnccagcagtgactttaacgaacttatactcctccgtcgtaaccaaacaaacctacccaggaacaaaccgacccccaaactcatagtattttagacggtacaagtaacgccgcctcgacgggtccagactcgtctctnacggtcctactagtctcggacaacnccggctccgtactcccgtctcgtacggtccctacgacgtacgtaggagtacgtggacggtactaggtactttaacgttccgtagtaccgagtctacctagttaacctcggacgagtacggaaccgaaggtacgggttacgtacggggacgacggtaaaccgtaagttccgaccgtcgtagcgtacggaccgacgtcgacccgtcccgtgtcctacgttcgtccgtacccgcccgttaccg

SEQ ID NO: 58918 - DNA, 799 bp, Homo sapiens
  misc_feature: GYAE6OF02HOWCY.8.42.D09.1.454.CMB.1.raw
  modified_base (198)..(198): a, c, t, g, unknown or other
  misc_feature (198)..(198): n is a, c, g, or t
  modified_base (717)..(717): a, c, t, g, unknown or other
  misc_feature (717)..(717): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcagggcacgcgggtcctgggccagtctgcctgactcagcctcctccggcgtccgggtctccgtaggacngtcaggttccacctacgtcctacctgactacgtcgggactccagtactacggtataacttaaccaattacttacgtccgtacgttaccggtaaccaaacctaaccgaacccgaaggtaccaaaccggaaccccctaaacgtacctacgttacgttcgttttacggaagttacgaaagtaccggccggtccgtacggtaccggggtacctgggtactcgtaccttcgacgtacgtcctacgtacgtcgtacggtaccaaccgtccggtccctccggtaccgtacgttcccggttacggtcgggtacctacggtactacggttacgggtacggtacgtagggtacggttacgttaaaccgttacggttacttacgtacgacggttacgttaccgttacgttaacgttacgtaaccgggcgggtaactaaccggaacgtaacgggtacggttcgggtaaccggggtacgggtaaacggtacttaacgggttacgttccgggttacggcgtaccgggtaaccnccggtaccggttccggttcccgtacccggttacgttaccggttaccgtccctttaccccgggtccgtaacccgtttacccgg

SEQ ID NO: 58919 - DNA, 799 bp, Homo sapiens
  misc_feature: GYAE6OF02I7606.8.42.D09.1.454.CMB.1.raw
  modified_base (317)..(317): a, c, t, g, unknown or other
  misc_feature (317)..(317): n is a, c, g, or t
  modified_base (710)..(710): a, c, t, g, unknown or other
  misc_feature (710)..(710): n is a, c, g, or t
  modified_base (765)..(765): a, c, t, g, unknown or other
  misc_feature (765)..(765): n is a, c, g, or t
tcagctcgcgtgtccacgaccggtgctcgatttagacacatacgcagggaaaggggtctgggagaggagcccagcactgggattccgaggtgtgtccattcggtgatcagcactgaacacagaggactcaccatggagttctggctgggctgggttttccttgttgcaatttcaaaggtgtccagtgtgaggtgcagctggtggagaatgggaggggcttgatccgaggcccgggggggtccctggagtacctcgtccgtgtgcacgcctcgtcggcttcaccatcaggtagagtactacatggagcgtcgggcccncgacggcctaccgaggggaacgggcgtgggtaggtgggtctcgtacgtttacgtttagtccggtacgtagttcgggttcggaaccgtacgtaaccgtacgttaccggtacgaaaccggtaccctacccgggttacgggaaccggggtcgtaaacggttccgtttaaccccgtaacccgggttcccttaaccccggaaggtaaacccgggtaacctaaacccggttttaaccccgaaaagtaacccgttaagggtttaccggggttaactttaaccgggtttaccctttaacgtaaaacgttacggaaacccgtaaagtaaacccgtaacgtaaccgggtacccggaaacggtaacccggccgggttaacccggttaatttacgtttaaccggnggttacggtaaccggaacggttacctaagttaccgggtaacgtttaacccggggnggaacccggttccccgggtagggggtacccccgg

SEQ ID NO: 58920 - DNA, 661 bp, Homo sapiens
  misc_feature: GYAE6OF02FIVFM.8.42.D09.1.454.CMB.1.raw
  modified_base (255)..(255): a, c, t, g, unknown or other
  misc_feature (255)..(255): n is a, c, g, or t
  modified_base (320)..(320): a, c, t, g, unknown or other
  misc_feature (320)..(320): n is a, c, g, or t
tcagctcgcgtgtccacgaccggtgctcgatttagacacatacgcagggaaagggggggggtctcaggaggcagcgctctcaggacgtcaccaccatggcctgggctctgctctcctcaccctctcactcagggcacaggtcctgggcccagtctcgccctgactcagtccctccctccgacgtccgggtctcctaggacagtcagtccaaccattctcctgcacgtgacgccagtcagtgaactacaactatanctctaggtaccaacaacaccgagacaaacacccaaactcatagattttaggacgtcaaagtaacnccggtacccgtacgtacggggtaccctgtactacgtccgttctacgacggtctacctaacgtcgtacggacgtaaccacccggtcctacccgtggacccttacgtaccgtcggtaccgtacctacggactgggtacgaacgtttaggacggtactaggtaaactttactacgtagtacgttacgactacttaagttactacgtaggactacgacgtaacggagggttacgtcgggaacggtaacggaacgtacgttacgaccgtttacgacgtcgtaaccgacgaacgtccgttccgaccccgtacggtacacccttcgttacccgtacccgtactacccg

SEQ ID NO: 58921 - DNA, 792 bp, Homo sapiens
  misc_feature: GYAE6OF02H53EH.8.42.D09.1.454.CMB.1.raw
  modified_base (126)..(126): a, c, t, g, unknown or other
  misc_feature (126)..(126): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcncactcagggcacagggtcctgggcccagtctgccctgactcagcctccctccgcgtccgggtctcctggacagtcagtcaccatctctgcactggagcagcagtgattacaactatatctcctggtaccaacaacacccaggacaaacgccccaaaactcatgtattttagagtacaataagccggcctacgacgggtccctagactcgtcttctccgaggcctaccgaagttctcggaccaaaccgtaccggtccctccccgtacggtaaccccgttcgttaccgtcgggggtccttacccgaaggtaccgttacgggaacggtacgttggggaaccggtacgttacggtaacgttttaaactttaccggttacgtaccggtaacggtacccttaccgtaaactttaccgttaccggaaaccggtcgtaaaccggtaaccgaaaccgttaaaggggggtttaacctttaccggggggtaccggggaaacggggtaaaccctttaaaacggggttaccgtaacccggtttacccggttaacggggttacccgtaccggaaacccccggtaaagggtccccgttacccggccccccccggtttacgggtacccgttaacccgttcccggtttacccggtttaccccccctaaaccccgttcccccgg

SEQ ID NO: 58922 - DNA, 920 bp, Homo sapiens
  misc_feature: GYAE6OF02FZNSH.8.42.D09.1.454.CMB.1.raw
  modified_base (222)..(222): a, c, t, g, unknown or other
  misc_feature (222)..(222): n is a, c, g, or t
tcagctcgcgtgtccacgaccggtgctcgatttagacacatacgcaggggaaagggggctgggggtctcgaggaggcagcgctctcgaggacgtcaccaccatggcctgggctctgctcctctcaccctcctcactcgaggcacgtcgggtcctgggccctagtctcgccctgactcagcctcctccggcggtccggtctcgtacggctacgtcagtcaacncttcgtacctgacctacgtaggactaccgagacgtaggtagtaacctaataaaccgttactacgttccgtacccgttacggaaaaccaaacaacccctaaccgaacgggaaaccgtaaacccgtaaccccctaaacgtacttaacggttacggtttaacttttacgggtaacgtaacgttaaacgtaaaccgggcccggtacgttaccgggaccgggttacccgttagggtaactccggttacttaccggtctacggtcctacggtacgtcctacgggacctaaccggtaccgtaccccgttccgtacggttacccgttacgttacgggtacccgttacggttaaccgacggtacgtaacggggacggttaacgtacgggtaccggtaactttaccggttaaacggttttaaacttcccgggaaacggtcccgtttaacggtaaccttaacttaaccggtaaacgggtttacctaaacgggtaaccggtacgtaaaaccgggttacgggtttacgtaaacggggtttaacccggggacggtttaaacgggaaacccgttcgggttaacccggttaaccggtacgggtacccggttaaccggtaaccggggtaccggaaccgttttaccccgacccgggtttccccggtaacgggttaccccgtcccggttttaccgggttcccccggttaacccccgg

SEQ ID NO: 58923 - DNA, 960 bp, Homo sapiens
  misc_feature: GYAE6OF02IFLCB.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctctactcgaggcacgtagggtacctcgggcccagtcctcgcctagactcacgtcctcccgtccgtccggtccggtactccgtaggacctacgtccgaacgtccaaccgtacttcccgtacctcgtacgtaaccgtcgggacgtacccgtacgaaccgtaggtaccggttaacttaaccgaaacgttaacctacgttccgttaacccgtacggttaaaccctaaacccgtaaacctaaccccggaaccgtaaacccgtaaaaccgtacccccctaaacgttacctaacgttacgtttaacgtttttaacggaacggttaaccgtaaaacgtacccggtaccggttaccgttaaccggtaccgggttacccgtaacgtacccggttacgtacccgtttaccgtaccgtacggtaccgttaccgtaacgttccggtaccggtaaccaaaccggttccccggtaacccgtaccggttacccgtaaccggttaccgtaccggtccgggtacccttaacggtccgttaacgttacggaaggttaccggtaaacgggtacgtaaaccgtttacgtaaccgtttaactccgtaaacgtaccttaccgttcctacgtaaacgtttccgtaacgacgacgtaaccggtaaccgttacggtaacgggttaaccggtacgggtaaaccgggttaccggtaaccgttaacgttaccggttaacgggtaccttcgggtaaaccgtacccgttaaccggtaaaccgggtccgtttacccccggtaaccggtaccgttaacccgtacggttttacccccggttaaccggtttccccgaccggtttaacccg

SEQ ID NO: 58924 - DNA, 770 bp, Homo sapiens
  misc_feature: GYAE6OF02FQBCL.8.42.D09.1.454.CMB.1.raw
  modified_base (336)..(336): a, c, t, g, unknown or other
  misc_feature (336)..(336): n is a, c, g, or t
  modified_base (691)..(691): a, c, t, g, unknown or other
  misc_feature (691)..(691): n is a, c, g, or t
tcagctcgcgtgtccacgaccggtgctcgatttagacacatacgcagggaaaggggggggagaggagcccagcactgggattccgaggtgtgtccattcggtgatcagcactgaacacagaggactcaccatggagttctggctgggcttgggtttttccttgttgctaattttacaaaaggttgtccagtgtggaggtgctagcgttgggtggaagtaagtggggagggggtctttgacgttcccgacgggccgggggggttaccctggacggaccttccttccgtgtcggtcacgtccgtactcgggtcttccgaacctataccgaacggttanaacggaccttaacagtgtacggcggtaccggggaccccgtacgaccggtacctaccgggaagggggtaacggggtcgtaggggtacggggtttcgggttaccgtagtaaggtttaattttacgcggacgttagtcgggtcgacacgtaccgtaacgtaccgagaacgtaccgtcccggtagggaacgggtactaacggtacgtaccgtacccggtactacggaaaggaccgtaaacaacgttaaccgaaacggtaactagttacgggttattaaccgttataaccgtaagtaacgaataaccggtaaccaaagtaccggacgaaccgaacgtaccggtacttaattacgtttacnggtacggaacgtaccgaataggttccaaggttacgggactaaccggacccgggaggtaccccggtacgggtaaccccgg

SEQ ID NO: 58925 - DNA, 834 bp, Homo sapiens
  misc_feature: GYAE6OF02GRT5G.8.42.D09.1.454.CMB.1.raw
  modified_base (279)..(279): a, c, t, g, unknown or other
  misc_feature (279)..(279): n is a, c, g, or t
tcagctcgcgtgtccacgaccggtgctcgatttagacacatacgcagggaaaggggggggtctcaggaggcagcgctctcaggacgtcaccacctaaaaaggcctgggctctagctcctctccacctcctcactcgagggcacagggtcctgggcccagtctgtactgacgcagccgcctcagtatcgtcgggcccagggcgaggtacgggtctcgactctccgtgctacgtgggacacgacgtaaccacgcgtaacggtcggggacctaaggtttacnggtacttgttaccgtagttcgggtaccccgacgtaacgggttaccgaggaccaaccggacccgtaccccggaacaacccgttccgtactaaattttaagaacggtaaactaaccgaaaccgtaacgttacccgggtacccttaccgggtaacggggttacccttaaccggtacggtaacccggttacttttaccggtacggttaccgtaccctaacccgttaaaggttccgtaccgggtaactttaacccgttcccgttccggtaaccccgttccggttttaacgggaaccttaacgttaccttttacgggtacccggtttaccgtcgggttaacgggggttacggtaacgggttaacgtaccggggttaagtaccgttaagggtttaactttaacgtaccggtacgtaccccgttaaccgtcgttaacgaacgttaaccgacgtacgttacggtacgttacgtttaacggtcggtacgttcggtacgggtcggacggtacgtacgtcggtaccgtcgtacgacgtaccgcgtaaccggtctcccgtacggtccg

SEQ ID NO: 58926 - DNA, 620 bp, Homo sapiens
  misc_feature: GYAE6OF02GDU1F.8.42.D09.1.454.CMB.1.raw
  modified_base (226)..(226): a, c, t, g, unknown or other
  misc_feature (226)..(226): n is a, c, g, or t
  modified_base (348)..(348): a, c, t, g, unknown or other
  misc_feature (348)..(348): n is a, c, g, or t
  modified_base (474)..(474): a, c, t, g, unknown or other
  misc_feature (474)..(474): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctcctccgcgtccgggtctccgtggacagtcagtcaccatctcctgcactgganccagcagtgattacactatatctcctggtaccaacaacacccaggacaaaccgccccaactccatacggtattttgacggtacaagtaacgccgcctacgtacgggtccctgactcgcttcncgaggtcctacagtcgacgtacacgaccgcctacctagaccgtctcgtacggcaccagtacgtcgaggtactggacggcttaggtacttaattcgcgtacgacgtctactattatcgagtcgtaanacgtaacgtagggttacgtacgggacggacgacgtaaggtccgtaaccggtcgtacgaccgtacggaacccggtaacggtccgtacccggtaccccgtaccggtacctaccttccggtacccggttcccccgtacccttaccccgg

SEQ ID NO: 58927 - DNA, 862 bp, Homo sapiens
  misc_feature: GYAE6OF02GJT8M.8.42.D09.1.454.CMB.1.raw
tcagctcgcgtgtccacgaccggtgctcgatttagacacatacgcagggaaaggggggggtctcaggaggcagcgctctcaggacgtcaccaccatcggcctgggctctgctcctcctcacctcctcactcgacgggcacagggtcctcgggcccagtctgccctgactcagcctcctcgcgtccggtctctcggacacgtcgtagcaccactctcctcgtcacgtcggacgaccgacgacgtacgtacgtacttaactaacctatacttccttcctacggtaaccaaccgaaccaacccgaacgaccaaaccgtaaccccctaaactaccacttacgttactttttaggacgtacgtaaacgtaacggtccggtacccgtacggtacggggtacccgtttacgaacgttccgtacctttacggtacgtacgggaccttaaccgtaacgttacggtccggtaccgtaaccggaacccggtccctacccgtccgggtaacccgttccggttaccggtaccggggtcccgttaacccgttaacggtaccggtaacggacgggttacggtacggtaccggttacggttacgtttaaacggtttaacgtttacggtacgtacggttaacgtccttacggttaacttacgtttacggacggtaccgtacggtaacgtaaccggggtacgggtacggttaccgggaccggggttaaaccggtacggttaacggttaaccggtaccgggttaccggtacggttacccggaaccggttaacccgtaccggtccgggtaccccgttacccggtttaccgtcccgttaaccgtttccggtttaccccgttaccccgttcccgttaaccccgg

SEQ ID NO: 58928 - DNA, 712 bp, Homo sapiens
  misc_feature: GYAE6OF02GO1JK.8.42.D09.1.454.CMB.1.raw
tcagctcgcgtgtccacgaccggtgctcgatttagacacatacgcagggaaaggggtgggagaggagcccagcactgggattccgaggtgtgtccattcggtgatcagcactgaacacagaggactcaccatggagttctggctgggcttgggttttccttgttgctaatttcaaaaggtgtccagtgtgaggtgcagctggtggagaagtgggaggggtcttgatccgagggcccggggggtccctggacgtacctccgtccgtggtcgcgagcctcgtcggtccttcaccctataccagtagagaacctacagtaggagcggtcgggccccgaccgacggccgtaccggaaggggaacggggtcgtacgggaggttcgggtctacgtagtttatttacgtcggacgtagtgggtcgacaacgacctacgtaacgcacgtaccgtccggtaggaacgggacagtacgttacccgaccgtcctacccgaataacgtaaacctaaccgttaaccgaaaagtaaaccgttagtacgttaagttaacttacgttaaacgaaaagtttaacgaaaacgttaccgtaaaccgttaaacgacgggtaacccgaacggtaaccgaaaccgggttactaagttacttacgtagtcgtacgaacgtactagtactaccggttaaggtcgaacccggtccggacgggtacccgtaaccgggg

SEQ ID NO: 58929 - DNA, 761 bp, Homo sapiens
  misc_feature: GYAE6OF02JEKUC.8.42.D09.1.454.CMB.1.raw
  modified_base (199)..(199): a, c, t, g, unknown or other
  misc_feature (199)..(199): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgacctcagcctccctccgcgtccggtctccgtgacngtcacgtcacatcctctgctacgtggacgccagcagtgattaccaactatacgtcctcgtacgtaaccaacgaaccaccgaacggaccaaaaccgaccccctaaaactacctaacgttacgttaacgtttttaggaacggttaccaaaagttaacggcccggtccccgttacggtaccggggttacccctggtaacttcccggtcttaccgtacgacggccttaccgtacgtacgtccggtaccaaccgtccggacccttccgtacgtacccgttcttacggtccggtcctaccgtacggacgtacggtaagggtacgttacgggaggttcgtagttaactttacgttaccgtcggtaccgttaacgtccttacgttactacgttacggaacggtaccgtaagtacccgtaaacggtacgggttaccgttacggggtaacgggacggtaaacccgtaggttaccggtaaccgtcgttacggaccgtaaccggccgtaacggtccgtacccggtcccgtcggtacctccgttacccttcccggtaccccgttaccgtacccgg

SEQ ID NO: 58930 - DNA, 545 bp, Homo sapiens
  misc_feature: GYAE6OF01BSUBX.10.53.E09.1.454.CMB.1.raw
  modified_base (539)..(539): a, c, t, g, unknown or other
  misc_feature (539)..(539): n is a, c, g, or t
tcagcatagtagtgcacgaccggtgctcgatttagagagagtgtgttgggtttgggctgagctgggtttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgaggacacggctgtgtattactgttcgtttggttctgactcgtcggggaataccttcagcacgtgggccagggcaccctggtcaccgtctcctcacgcctccaccacggcccactccggtccttcccccgtcggcccacccctcctcccaacgacgccacctccgtggggccacgnggccgg

SEQ ID NO: 58931 - DNA, 507 bp, Homo sapiens
  misc_feature: GYAE6OF01CQJOY.10.53.E09.1.454.CMB.1.raw
  modified_base (482)..(482): a, c, t, g, unknown or other
  misc_feature (482)..(482): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttaagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggctagtttattactgtcagctatattaatacgtacccattcacacttcggcccgtagggaccaaaggtggaanatacaaacgaactgtcggctggacc

SEQ ID NO: 58932 - DNA, 171 bp, Homo sapiens
  misc_feature: GYAE6OF01ESZZ1.10.53.E09.1.454.CMB.1.raw
  modified_base (171)..(171): a, c, t, g, unknown or other
  misc_feature (171)..(171): n is a, c, g, or t
tcagcatagtagtgcacgaccggtgctcgatttagagagagtgtgttgggtttggggaagaggaagactgacggtccccaggagttcaggtgctgggcacagcggccctgggctgcctggtcaaggactacttcccactactatgctgagcgggctggcaaggcgcatagn

SEQ ID NO: 58933 - DNA, 558 bp, Homo sapiens
  misc_feature: GYAE6OF01D39EX.10.53.E09.1.454.CMB.1.raw
tcagcatagtagtgcacgaccggtgctcgatttagagagagtgtgttgggtttgggctgagcggtggtttcgtcgtaggctctttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattacgtgttcgtttggttctgacgtcggtcggggaataccgttcagcacgtggggccagggcaccgtggtcaccgtctctcacgcctccaccacgggcccagtccggtcccttccccgtcggcctacccctcccgtcccaacgcgaccacccgtcgtgggggccacgcggcccggg

SEQ ID NO: 58934 - DNA, 583 bp, Homo sapiens
  misc_feature: GYAE6OF01B6797.10.53.E09.1.454.CMB.1.raw
  modified_base (253)..(253): a, c, t, g, unknown or other
  misc_feature (253)..(253): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttanctcatttgatggagacaataaatactacagagactccgttcggggccgattcaccatctccaaagacaacttagtaagaaacaacgactcgtttctgcgaaactagaacaagacctcgagagctgaggacacgcgtgtgtattacttgttcgtttggttcgttgacgtcgtcgggggaacgtaaccttcgagcgacgtcggggccgagggaccgacccgtcggtcgacccgtactccctcacgcctccacccgaaggcccatccggtccttcccctcggccaccctccctccaacgacgcgaccctcctgggggccaccgacgtcccggg

SEQ ID NO: 58935 - DNA, 502 bp, Homo sapiens
  misc_feature: GYAE6OF01B03GD.10.53.E09.1.454.CMB.1.raw
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaagctgctcatttacngggcatctacccgggaatccgggtcctgaccgattcagtgcagcggtctgggacagatttcactctcaccatcagcagcctgcaggctagaagatgcggctagtttnttactgtcagtcactattatagtaccccattcacagttcgccctgggaccaaagtggaacgtactcgaaaacactgtggtaccg

SEQ ID NO: 58936 - DNA, 175 bp, Homo sapiens
  misc_feature: GYAE6OF01DUOPO.10.53.E09.1.454.CMB.1.raw
  modified_base (173)..(175): a, c, t, g, unknown or other
  misc_feature (173)..(175): n is a, c, g, or t
tcagcatagtagtgcacgaccggtgctcgatttagagagagtgtgttgggtttgggggaagaggaagactgacggtcccccaggagttcaggtgctgggcacagcggccctgggctgcctggtcaaggactacttcccactactatgctgagcgggctggcaaggcgcatagnnn

SEQ ID NO: 58937 - DNA, 528 bp, Homo sapiens
  misc_feature: GYAE6OF01DPR1L.10.53.E09.1.454.CMB.1.raw
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactcgttcgggccgattcaccatctccaaagacaatttgaagaacacgctgtttctgcaaatgaacagcctgagagctgaggacacggctgtgtattactgttcgttggttctgactcgtcggggaatacttcagcactgggccagggcacctgtcaccgtctcctcagcctccaccacggccactcgtcctcccctcgccaccctcctccaacgacgccacctcgtggggcncgnggcccgg

SEQ ID NO: 58938 - DNA, 558 bp, Homo sapiens
  misc_feature: GYAE6OF01DT1RY.10.53.E09.1.454.CMB.1.raw
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctagtttctgcaaatgaacagcctgagagctgaggacacggctgtgtattactgttcgtttggttctgtacgtcgtcggggaataccttcagcacgtggggccagggcacccgtggtcaccgtctcctcacgcctccaccacgggccactcggtccttccccgtcggccaccctcctcccaacgacgccaacctcgtcgggggccacgacggccggccccgtgggcctggcccgtcggg

SEQ ID NO: 58939 - DNA, 540 bp, Homo sapiens
  misc_feature: GYAE6OF01AJ2JW.10.53.E09.1.454.CMB.1.raw
  modified_base (306)..(306): a, c, t, g, unknown or other
  misc_feature (306)..(306): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaagctgctcatttacngggcatctacccgggaatcccgggtcctgaccgattcagtggcagcgggtctgggacagatttcactctcaccatcagcagcctgcaggctgaagatgcggctagtttatactgtcagctactacttatacgtaccccattccactacgttccggacccgtaggggaaccctaaagggtcggaaacgtaacgttaaccgaaaaccggtaacttaggtacgggtccttaggaccc

SEQ ID NO: 58940 - DNA, 526 bp, Homo sapiens
  misc_feature: GYAE6OF01CMVGJ.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatcctaccgggaatccgggtcctgaccgattcagtggcagcggtctggacagatttcactctcaccatcagcagcctgcaggcctagaagatggcgactagtttatacgtgtacagctacttattactacgtacccctattcactacgttccggcccttagggaacccaaaggtggaacgtactaacaaacggtaaactggtaggtaccg

SEQ ID NO: 58941 - DNA, 548 bp, Homo sapiens
  misc_feature: GYAE6OF01CMOFI.10.53.E09.1.454.CMB.1.raw
  modified_base (315)..(315): a, c, t, g, unknown or other
  misc_feature (315)..(315): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagaggccaccatcaactgcaagtccagccagagtgttttatcagctaccaacaataagaactacttagcttggtaccagcaagaaaccaggacagcctacctaagctgctctatttacngggcatcctaccgggaactcccgggtcctagaccgattcagtgcgagcgggtctggacagtattcacttctcaccatcagcagcctgcaggctagaagagtcgcggactaggttttactacgtgtacagtctaacgttattactacgttaccccctattccaactacgttccggcccgttacgggaacctaaaggtcggaacgtaactaccgaaacgtaacgtggtgggtacc

SEQ ID NO: 58942 - DNA, 174 bp, Homo sapiens
  misc_feature: GYAE6OF01DCH4C.10.53.E09.1.454.CMB.1.raw
  modified_base (173)..(174): a, c, t, g, unknown or other
  misc_feature (173)..(174): n is a, c, g, or t
tcagcatagtagtgcacgaccggtgctcgatttagagagagtgtgttgggtttgggggaagaggaagactgacggtcccccaggagttcaggtgctgggcacagcggccctgggctgcctggtcaaggactacttcccactactatgctgagcgggctggcaaggcgcatagnn

SEQ ID NO: 58943 - DNA, 534 bp, Homo sapiens
  misc_feature: GYAE6OF01EF97M.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatcctacccgggaatcccggggtcctgaccgattcagtggcagcgggtctgggacagatttcactctcaccatcagcagcctgcaggctgaagatgcggctagttttatactgtacagctaacttattactacgtacccctattaccactacgttccggcccgtagggaaccctaaaggtcggaagtactaacgtaaaacgacttaggtcggccgtgaacccg

SEQ ID NO: 58944 - DNA, 172 bp, Homo sapiens
  misc_feature: GYAE6OF01C33QO.10.53.E09.1.454.CMB.1.raw
tcagcatagtagtgcacgaccggtgctcgatttagagagagtgtgttgggtttgggggaagaggaagactgacggtcccccaggagttcaggtgctgggcacagcggccctgggctgcctggtcaaggactacttcccactactatgctgagcgggctggcaaggcgcatag

SEQ ID NO: 58945 - DNA, 525 bp, Homo sapiens
  misc_feature: GYAE6OF01AZMXW.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatcgtacccgggaatccgggtccctgaccgattcagtgcagcgggtctggacagtattcactctcaccatcagcagcctgcaggctgaagatgcggctagtttattactgtacagtctactattactacgtacccctattccactacgttccggccctacgggaacccaaaggtggaagtaactacgaaaaccgtacgtgtcggtaccg

SEQ ID NO: 58946 - DNA, 529 bp, Homo sapiens
  misc_feature: GYAE6OF01BJOJU.10.53.E09.1.454.CMB.1.raw
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (407)..(407): a, c, t, g, unknown or other
  misc_feature (407)..(407): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccacatcaactgcaagtccagccagagtgttttatcagctccgacaataagaactacttagcttggtaccagacagaaaccaggacagcctacctaagctgctacatttacnggcatcgtaccgggatccgggtcctgaccgattcgagtgcgaggcggtctagggacagtacttcacttcncaccatcagcagcctgcgagctagaagntcggacgtctagtttactacgtgtactagactacttattactacgtaccctattccactcgtccgccgtggaaccaaggtcggaacgtactacgtaaacgtactaggtcggtcgtgtacccg

SEQ ID NO: 58947 - DNA, 174 bp, Homo sapiens; identical to SEQ ID NO: 58942
  misc_feature: GYAE6OF01AICTB.10.53.E09.1.454.CMB.1.raw
  modified_base (173)..(174): a, c, t, g, unknown or other
  misc_feature (173)..(174): n is a, c, g, or t

SEQ ID NO: 58948 - DNA, 518 bp, Homo sapiens
  misc_feature: GYAE6OF01ALUM7.10.53.E09.1.454.CMB.1.raw
  modified_base (310)..(310): a, c, t, g, unknown or other
  misc_feature (310)..(310): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcagagggccaccatcaactgcaagtccagccagagtgttttatcagctccgacaataagaactacttagcttggtaccagcagaaaccaggacagcctcctaagctgctcatttacngggcatctacccgggaatccggggtccctgaccgattcagtggcagcgggtctgggacagatttcactctcaccatcagcagcctgcagctagaagatgcggctagtttatactgtacacgcactattatacgtaccccattccactacttccggccctagggaccctaaaggtacggacgtaacttaccaaaacgactggtggtacg

SEQ ID NO: 58949 - DNA, 551 bp, Homo sapiens
  misc_feature: GYAE6OF01EPRPK.10.53.E09.1.454.CMB.1.raw
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaataccgttcagcacgtggggccagggcacccgtggtcaccgtctcctcacgcctccaccaacgggcccagtccggtccttccccctggccaccctcctcccaagacgccacctcgtcgggggccacgacgccggccctgggctgccgtacggg

SEQ ID NO: 58950 - DNA, 562 bp, Homo sapiens
  misc_feature: GYAE6OF01BCGAB.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgtacgtcggtcggggtaataccttcgagcacgtggggccagggcacccgtggtcaccgtctccctcacgcctcccaccacgggcccacgtccggtccttcccccgtggccctacccctcctcccaacgacgccacccgtcgtacggggcacgcggcccggg

SEQ ID NO: 58951 - DNA, 522 bp, Homo sapiens
  misc_feature: GYAE6OF01C46BP.10.53.E09.1.454.CMB.1.raw
  modified_base (411)..(411): a, c, t, g, unknown or other
  misc_feature (411)..(411): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatcgtacccgggaatccgggtccctgaccgattcagtggcagcgggtctgggacagtatttcactctcaccatcagcagcctgcaggctagaagntgcggctagtttatactgtcagtctactattatacgtaccctattccactacgttccggcccgtagggaacccaaggtggaacgtactacgaaaacgtactggtggtaccg

SEQ ID NO: 58952 - DNA, 551 bp, Homo sapiens
  misc_feature: GYAE6OF01B8MTV.10.53.E09.1.454.CMB.1.raw
  modified_base (447)..(447): a, c, t, g, unknown or other
  misc_feature (447)..(447): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtcctcaggctccaggcaaggggctggagtgggtgcagttatctcattgatggagacaataaatactacagagactccgttcggggccgattcaccatctaccaaagacaatttagaagaacacgctgttctgcaaatgaacagcctgagagctgaggacacggctgtgtattactgttcgtttggttctgactcgtcggggtaataccttcagcacgtgggccagggcaccgtgtcnccgtctcctcacgcctccaccgacggcccatccggtccttccccgtcggtccctacccctccctccaacgacgaccaccctcgcggggccacggcgtcccgggg

SEQ ID NO: 58953 - DNA, 558 bp, Homo sapiens
  misc_feature: GYAE6OF01AZOCM.10.53.E09.1.454.CMB.1.raw
  modified_base (214)..(214): a, c, t, g, unknown or other
  misc_feature (214)..(214): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtgcagcctctggattgaggttcaataactatgctatgcactgggtccnccaggctccgagggaagggctggaatggatgacagttattcacacgatgcaaaccaaaacatactacgcggtaagttcgtgaggggccgctggcagtcgtctccagagacaattcgaaagacactctgtactgacaaatgaacagtctgagagccgagacacggccgtctactttgtgcgacgtagaagtggagcgtagtagggtatttagattccgtgggccgacgggtaacccgtcggtccgtaccgtcctccgtccacgccctcccgaccgacggcccacgtccgtccgttccccgtcgccctaccctccctaccacgacgccaccgccgtggggcaccgg

SEQ ID NO: 58954 - DNA, 729 bp, Homo sapiens
  misc_feature: GYAE6OF01AB6GK.10.53.E09.1.454.CMB.1.raw
  modified_base (149)..(149): a, c, t, g, unknown or other
  misc_feature (149)..(149): n is a, c, g, or t
  modified_base (214)..(214): a, c, t, g, unknown or other
  misc_feature (214)..(214): n is a, c, g, or t
tcagcatagtagtgcacgaccggtgctcgatttagagagagtgtgttgggttggctgagctgggtttcctcgttgctctttaagaggtgtccagtgtcaggtgcagctggtggagtctgggggagcgtggtccagcctgggagtccctnagactctcctgttacgcctctggattcaccttcagttagttactccttgcctacgtgggtccctnaggcctaccgaggcgaaggggctggagtgggtgctagttatctcatttgatggagacaataaatactacagagactcggttcgggcctattcaccatctaccaaagactaatttgaacgtaacacgtcttagtttctagactaaagtcgaaacgacgcctggaacgtagccgtaggaacggaccgaacgggtcttggtacgttaatttacgttcgtttcggtttggtttaccgtacggtacgttacgggtaacgggggtaacttacccgtttacgacggtaccgtaccggtcgggggacccgacggggtaccctaccccggtcgggtacccgtaacccgttccgttcccgttaccgaaccgtccccttacccgaacccggaaccgggtccccgtaacgttcccgggttaccccttcccccggtcgggtacccctacccccgttccctacccgtaaacggtaccgtacccgtaaccccgttcggtaccgggggacccaaccggtcgggtccccggg

SEQ ID NO: 58955 - DNA, 608 bp, Homo sapiens
  misc_feature: GYAE6OF01E05YV.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttggtaccagcaagaaacccaggacacgcctcctaagctgctctatttactgggctatccgtaacccgggaatcccgggtcctgaccgattcgagtggcaggcgggtctgggactagtacttcactcctcaccatcagcagcctgcagggctaggaagtacgtcggacggtctaaggttttacttaacgtcgtactacggtacttaacgttaatttaacgtaaccgttaaccccctaatttaccgaaaccttacggtttcccggacccccggttaaggggaaacccctaaaaggttcgggaacgtaacgttaaccaaaacggtacgttacggtcgggtaccg

SEQ ID NO: 58956 - DNA, 511 bp, Homo sapiens
  misc_feature: GYAE6OF01CT2UF.10.53.E09.1.454.CMB.1.raw
  modified_base (411)..(411): a, c, t, g, unknown or other
  misc_feature (411)..(411): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccgggtccctgaccgattcagtggcaggcggtctgggacagatttcactctcaccatcagcagcctgcaggctagaagatgcggtnagttttactactgtcagctatattatacgtacccattcactattccggcccgttagggaccctaaaggtggaagtacacgaaacgactgtcggctggacc

SEQ ID NO: 58957 - DNA, 785 bp, Homo sapiens
  misc_feature: GYAE6OF01EIRCH.10.53.E09.1.454.CMB.1.raw
  modified_base (159)..(159): a, c, t, g, unknown or other
  misc_feature (159)..(159): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
tcagcatagtagtgcacgaccggtgctcgatttagagagagtgtgttggggtttgggctgagcgtgggtttcctcgttgctctttaagaggtgtccagtgtcaggtgcaggctggtggagtcgtgggggaggcgtggtcccaggcctgggaggtccctnagactctcctgtttagccctctggtacttccacctttcagttagtttatcctttgctacgtggggtcctcgaggcctccgaggcgtaaggggctggagtgggtggcagttanctactatttgatgganacaataaatactacgagagaccgtccggttacgggccgtattccaccattctaccaaagtactaacgtttacggaaacgtaactacgtccgttagttttaccgtagtactaaaagtcggtaaaccgacggtcccgtaggaaggacggtaccgtagggaacgggaaccgtacggtacgttacggttagtttaacgttttaccgttaggttttaccggtttttaggttaccgttaggtaccgttaccggggttacggggtaaaccttacgttcaacgggtcctacgggtacgggtaccgtaacgggtcctaacccggtcggttaccctaccggttccctacccgtaccgtaccggtacccttacccggaaccggaaccgggtccccgtacgttcccgggttcccgttacccccgtaggtacccctacccccgtacctaccggaaaccgtcgtaccccgtaccgtacccggggtacgggaccctaccggcggtaccccggg

SEQ ID NO: 58958 - DNA, 575 bp, Homo sapiens
  misc_feature: GYAE6OF01DF8WC.10.53.E09.1.454.CMB.1.raw
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcgggcattcaccatctaccaaagacaatttgaanaacacgctgtttcngacaaatgaacagcctagagagctgaggacacggctagtgtattacgtgttcgtttagttctgtacgtcggtacggggaataccgttcagcacgtcggggaccagggtccaccgtggtaccaccggtactcctcgacgccctccaccgtaacggccctacgtccgtccctccccgtcggcctacccctcctaccaacgcgcctaccgtcggtacggggccacgacggtcccggg

SEQ ID NO: 58959 - DNA, 526 bp, Homo sapiens
  misc_feature: GYAE6OF01CTW1W.10.53.E09.1.454.CMB.1.raw
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcagagggccaccatcaactgcaagtccagccagagtgttttatcagctccgaacaataagaactacttaagcttggtaccagcagaaaccaggacagcctcctaagctgctcatttactggcagtcgtacccgggaactccgggtccctgaccgattcagtggcaggcgggtntgggacagattcactctcacatcagcagcctgcaggctagaagatgcgatagtttatactgtacngtcactaattacaacgtacccctattaccatacgttccggccccgtaggggaacccaaaggtggaacgtataaccgaaacgtaacgtggtggac

SEQ ID NO: 58960 - DNA, 668 bp, Homo sapiens
  misc_feature: GYAE6OF01DX3AH.10.53.E09.1.454.CMB.1.raw
  modified_base (331)..(331): a, c, t, g, unknown or other
  misc_feature (331)..(331): n is a, c, g, or t
  modified_base (360)..(360): a, c, t, g, unknown or other
  misc_feature (360)..(360): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagactccctgcctgtgtctcgtgggcgaggacggccaccatcaactgacaagtccagccagtagttgttttatcagctaccgacaaataagaactacttagcttacggtaccagacaacgaaaccaggacacgcctaccgtaagctgctactatttacgnggcagtccgtaaccgggactccgggtccngaccgtattcgaggtcggacgaggcgggtacgtgggactacgtactttccgaacttccgtacaaccgtatccaacgccgacgtcccgtgaccgagggtacctaggaagtacggtcggtacggtacgttaacgttttaataccgttaggtacctaacggtacctaacgtttaacttaacgtacccgttaaaccccctattaccccgtaacgttaccggtttcccgggaaccccggttaacggggaaacccgtaaaaggttcgggaacgtaacgtaaacccgaaaaccggtaacgttggtacggtaccgg

SEQ ID NO: 58961 - DNA, 582 bp, Homo sapiens
  misc_feature: GYAE6OF01BG4TM.10.53.E09.1.454.CMB.1.raw
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (426)..(426): a, c, t, g, unknown or other
  misc_feature (426)..(426): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatgacccagtctccagactccctgcctgtgtctcgtgggcgaggacgggccaccatcaactgacaagtccagccagtagttgtttatcagcctccganaataagaactactagcttggtaccagcaagaaaccaggacagcctactaagctgctnactttacgngggacataccgtacccgggatcccggggtccagaccgtattcagtcggcagggcgggtcagggacagtactttcactctcaccatcagccacgctcgcaggctagaacgntcggcggtcttagtttactacgtgtacctagtactacttaattactaacctaacccctattaccaacgtaccgttcccgggaccccgtagggtaaacccctaaagggtcggaacgtaacaaccgtaaaaccggacttagggttcgaccgtgaaccc

SEQ ID NO: 58962 - DNA, 561 bp, Homo sapiens
  misc_feature: GYAE6OF01EP1FF.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttgtaccagcaagaaaccaggacagcctacctaagctgctcatttactgggctacgtcgtacccgggacgtccgggtccctgaccgtattcgaggtcggcgaggtcgggtcgtggacagtactttcactctaccacctatcacgcacgtcctgcaggtcctagaacgatcggcggtcttaagtttacttacgtgtctagtactaactattataccgtaccctattaccactacgttcccggacccgtacgggaacctaaaggtggaacgtaactacgaaacgtacgtggtagtcg

SEQ ID NO: 58963 - DNA, 915 bp, Homo sapiens
  misc_feature: GYAE6OF01C9DHJ.10.53.E09.1.454.CMB.1.raw
  modified_base (116)..(116): a, c, t, g, unknown or other
  misc_feature (116)..(116): n is a, c, g, or t
  modified_base (234)..(234): a, c, t, g, unknown or other
  misc_feature (234)..(234): n is a, c, g, or t
tcagcatagtagtgcacgaccggtgctcgatttagagagagtgtgttgggtttgggggagctacaacaggcaggcagggcagcaagatggtgttgcagacccaggtcttcatttcnctgttgctctggatctctggtgcctacggggacatcgtgatgacccagtctccagactccgtgcctgtgtctcgtgggcagagggccacagtcaactgacaagtccagccagtagttntttactcgacgtctaccgactaaacgtaagtaacctacgttacgcgtttacgggtaccaggtaccaacggaaacccgtagggtacctaggtaccccgttacgttaaacggtccgttacgggtaccttacgtaacgtttttaccggacggggtacctaacggtttacccggtaacccggggtaaactttccccggggggttaccccttagggtaaaccccggttaactttccggtaacgggttaccgggaccgttaaccgggggtaccggggttttaccgtacggggggttaaccccttaagggtttaccgtttttacccgggaacccgttttacccggttaacccgtaacccgggttaaccgttacccgggttaaaccggttacccggttaaaccggtcccggttaagggtccccgttaaacggggttaccgtttaaccggtaaaacggttcggttacccggtaccgggtttaaccgtttaacggtttttaaccgttaaccgttagggtaacccgttaacggttacccgtaaccgtttaacggtttaccgtaaccggttacccttacgttaacccgtacggttaaccgttcccgggtacccttacgggtaaaccgtaaacgggtttcggaaacgttacccggttaacgtaaacccggtacggtttacggtcggttaacccg

SEQ ID NO: 58964 - DNA, 585 bp, Homo sapiens
  misc_feature: GYAE6OF01CJYQ9.10.53.E09.1.454.CMB.1.raw
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctgccctgtgtcctcgtgggcgaggacgggccaccatcaactgcaagtccagccagtgttgtttatcagctccgaacaataagaactacttagcttgtaccagcaagaaaccaggacagcctacctaagctgctctatttacgnggcatccgtacccgggaagtcccgggtcctagacccgtattcgagtcggacagggccggtntgggactagtacttcactctacaccatcagacagcctgacgaggccttaggaagngtgccggattagtttaacttacgtcgtacacgacctaacttacgttactaaccgtacccctattaccaacgtacgttccggacccgtagggaaacccgtaaaggtcggtaagtaacgtaaccaaacggttaacgtggtccggtaccg

SEQ ID NO: 58965 - DNA, 522 bp, Homo sapiens
  misc_feature: GYAE6OF01A0L7Y.10.53.E09.1.454.CMB.1.raw
  modified_base (316)..(316): a, c, t, g, unknown or other
  misc_feature (316)..(316): n is a, c, g, or t
  modified_base (346)..(346): a, c, t, g, unknown or other
  misc_feature (346)..(346): n is a, c, g, or t
  modified_base (405)..(405): a, c, t, g, unknown or other
  misc_feature (405)..(405): n is a, c, g, or t
tcagcatagtagtgcacgaccggtgctcgatttagagagagtgtgttgggtttgggggagctacaacaggcaggcaggggcagcaagatggtgttgcagacccaggtcttcatttcgtctgttgctctggagtctctggtgcctacggggacatcgtgatgacccagtctccagacctccctgccttgtgtctctgggcgagagggccaccatccaactgcaagtccagccagagtgttttatcagctccgacaataagaactacttagcttggtaccagcaagaaaccaggacagcctcaagctgctcatttacnggcatcgtaccggatccgggtcctgaccgntcagtgcagcggtctggacagattcactctcaccatcagcagcctgcaggctagaagangcgctaagtttactagtgtcgagctactattataccgtacccattccactacgttcccggcccgttacgggaaccctaaaggcggaacgtactaccaaaaccggactgggtcgtacg

SEQ ID NO: 58966 - DNA, 582 bp, Homo sapiens
  misc_feature: GYAE6OF01B7Q8T.10.53.E09.1.454.CMB.1.raw
  modified_base (325)..(325): a, c, t, g, unknown or other
  misc_feature (325)..(325): n is a, c, g, or t
  modified_base (385)..(385): a, c, t, g, unknown or other
  misc_feature (385)..(385): n is a, c, g, or t
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacggggacatcgtgatgacccagtctccagacctccctgcctgtgtctcgtgggcgagacgggccaccatcaactgacaagtccagccagagttgttttatcagctccgaacaataagaactacttagcttacggtaccagacaagaaaccaggacagcctactaagctgctctatttacgnggacactccgtacccgggaacgtccgggtcctcgaccgtattcgagtggcaggcggtcgnggacagtattcactctcaccatcagcacgcctgcaggctagaagcgtggcggtacttagtttactacgtgtactagacttacttaattactaccgtaacccctattacctaacgtacgttcccggacccgtaacggggtaaaccctaaagggtacggtaacgtaacgtaaccaaaacggtacgttcggtcggtaccg

SEQ ID NO: 58967 - DNA, 532 bp, Homo sapiens
  misc_feature: GYAE6OF01EWJPU.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccgggtcctgaccgattcagtggcagcgggtctgggacagatttcactctcaccatcagcagcctgcacggctagaagatgcggctagtttattactgtcagctatacttatacgtacccctattaccactacgttccggaccccgttagggaaccctaaagtcggaacgtaacgtaccgaaaacgtaactggtcggtaccg

SEQ ID NO: 58968 - DNA, 705 bp, Homo sapiens
  misc_feature: GYAE6OF01CDKMO.10.53.E09.1.454.CMB.1.raw
  modified_base (259)..(259): a, c, t, g, unknown or other
  misc_feature (259)..(259): n is a, c, g, or t
  modified_base (695)..(695): a, c, t, g, unknown or other
  misc_feature (695)..(695): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatcgacccagtctccagacctccctgcctgtcgtctcgtgggcgaggacggcccaccatcaactgacaacgtccagccagtagttgttttatcgagtcctaccgaanaaataaacgaacttacttagtcgttacggtaaccagacgaaacgaaaccgagaccacgtacctacctaagctcgtacttactagttacgtggactacgttacccggtaacccgggtaacgtcccggggtaccctacggaaccgtacgttacggacggtacggaccgtacgggtccggtacgtacgggactacgttactttccaccgtccaccgtaactacgaccgtaacggcctacggtcctggaccgtaggtacgtaacggtaaggtcgtacggtaccgttatttaacgtttacttacgcgttaaccgacgttacttaccgttaagtttacccgtaacccgttacctaccttaccgtaccgttaccggttccccggaaacggtaacggaaacggtaggtacgaaactaaccgtaacgaaccgttcgtagcccgtntccgtaaccg

SEQ ID NO: 58969 - DNA, 582 bp, Homo sapiens
  misc_feature: GYAE6OF01DVTK9.10.53.E09.1.454.CMB.1.raw
  modified_base (563)..(563): a, c, t, g, unknown or other
  misc_feature (563)..(563): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtggggtggcagttatctcatttgatggagacaataaatactacagagactccgttcggggccgattcaccatctaccaaagacaatttgaaagaacacgcttgtttctgacaaatgaaacagcctgagagctagaggacacggctgtgtattactgtttcgtttggttctgacgttcggtacggggtaactaccttcgagtcgtacgtcggggccgacgggccaccgtcggtcacccgtctcccgtcacgccctccaaccgacggccacgtccgtccttcccccgtgccctacccctcctcccgaacgacgccacccgttcggnggggccacgcggtcccggg

SEQ ID NO: 58970 - DNA, 559 bp, Homo sapiens
  misc_feature: GYAE6OF01DRDFI.10.53.E09.1.454.CMB.1.raw
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagacgggccaccatcaactgcaagtccagccagagtgtttatcagctccgacaataagaactacttagcttggtaccagcagaaaccaggacagcctctaagctgctcatttacngggcatcgtacccgggaatccgggtccctgaccgattcagtggcaggcgggtctgggacagtactttcactctccaacatcagtcagcctgcaggtctagaagngtgcgtactagttttaattacgtgtcgacgtctaacttacttactacgttaaccccctagttaccctaactacgttcccgggacccgttagggtaaaccctaaaggtcgggaaagacgtaaacaaacgtaacgtggtggtaccg

SEQ ID NO: 58971 - DNA, 588 bp, Homo sapiens
  misc_feature: GYAE6OF01BV1EI.10.53.E09.1.454.CMB.1.raw
  modified_base (575)..(575): a, c, t, g, unknown or other
  misc_feature (575)..(575): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcggggccgattcaccatctaccaaagactaatttgaagaacacgcttgtttctgacaaatgaacagcctgagagctgaggacacggtctgtcgtatttacgtgtttcgtttggttctgtactcggtcggggtaactaccgttcgagtcacggtcggggaccacgggcctacccgtcggtccacccgtctcctcacgccctaccaccgacggcccacgttccggtcccttccccgtcgccctacccctccctcccaacgcgccctacctccggcggggaccncgcggtccccggg

SEQ ID NO: 58972 - DNA, 564 bp, Homo sapiens
  misc_feature: GYAE6OF01AISBD.10.53.E09.1.454.CMB.1.raw
  modified_base (245)..(245): a, c, t, g, unknown or other
  misc_feature (245)..(245): n is a, c, g, or t
  modified_base (360)..(360): a, c, t, g, unknown or other
  misc_feature (360)..(360): n is a, c, g, or t
  modified_base (551)..(551): a, c, t, g, unknown or other
  misc_feature (551)..(551): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttagcctctggattcaccttcagtagttatcctttgcactggggtccgtcaggctccaggcaaggggctgggagtggggtggcagttatctcatttgatgganacaataaatactacagagactccggttcggggccgtattcaccatcctaccaaagacaatttgaagactacgtctgtttctgacaatacgaacagacctggagagctggaggacgacggctgtgttagttacgttggtttcggtttggttcttcggtaccgttcgggtaccggggtaacttacccgttcgnggtccgtaccggg

SEQ ID NO: 58973 - DNA, 592 bp, Homo sapiens
  misc_feature: GYAE6OF01C5MFV.10.53.E09.1.454.CMB.1.raw
  modified_base (330)..(330): a, c, t, g, unknown or other
  misc_feature (330)..(330): n is a, c, g, or t
  modified_base (465)..(465): a, c, t, g, unknown or other
  misc_feature (465)..(465): n is a, c, g, or t
  modified_base (521)..(521): a, c, t, g, unknown or other
  misc_feature (521)..(521): n is a, c, g, or t
tcagcatagtagtgcacgaccggtgctcgatttagagagagtgtggttgggtttgggggagctacaacaggcaggcaggggcagcaagatggtgttgcagacccaggtcttcatttctctgttgctctggatctctggtgccgtacggggacatcgtgatcgacccagtctccagactccctgcctgtcgtctcgtgggcgaggacgggccaccatcaactgacaagtccagccagagttgtttatcagctaccgaacaataacgaactacttagcttggaccagacaagaaaccaggacacgcctacctaagctagctactatttacgngggcaagtcccgtaacccgggaagtcccggggtaccctaggaacccgtattccgaggtggacacgggcgggtcgtacggggactaggtactttccacgttctaccaccatcagcacgcctgacgaggctagaagngtcggcgtacttaagttttactacgtgtacagactaacttataactaccgtacccnttaccactacggttcccggacctagggaaaccctaagggtgaacgtaactaacgaaactacgtggcgtacg

SEQ ID NO: 58974 - DNA, 672 bp, Homo sapiens
  misc_feature: GYAE6OF01C0K78.10.53.E09.1.454.CMB.1.raw
  modified_base (394)..(394): a, c, t, g, unknown or other
  misc_feature (394)..(394): n is a, c, g, or t
  modified_base (648)..(648): a, c, t, g, unknown or other
  misc_feature (648)..(648): n is a, c, g, or t
  modified_base (656)..(656): a, c, t, g, unknown or other
  misc_feature (656)..(656): n is a, c, g, or t
tcagcatagtagtgcacgaccggtgctcgatttagagagagtgtgttgggtttgggctgagcgtggtttcctcgttagctctttaagaggtgtccagtgtcaggtgcagctggtggagtcgtgggggaggcgtggtccagccgtgggaggtccctcagactctcctgttagcctctggattcaccttcagtagttatcctttgctacgtgggtccgtcgggctccgaggcgaaggggctggaggtgggtggcagtttatctctatttgatggagaacaaataaatactacagagactccggttacggggcctattcaccatctaccaaagacaatttgaaagaacacgcttgttctagacaaatgaacacgcctaggagagtctggaacggacncggtagtggtgttacttacgttgttcggttttcggttcttaggtacgtcgggtacggggtaacttaccgttacgacgcgtacgtcggggacccgacgggtacctaccccgtggtacccgtaccggttcctcccgtaccgaccgtccctacccgaaccggtaaccgggtaccctacgtccccggtcccgttccccccgttcggccctaacccccgtcctacccgaaacgtcgacccctacgtcccgggtcggganaacccggnggtcccgggtccccgg

SEQ ID NO: 58975 - DNA, 531 bp, Homo sapiens
  misc_feature: GYAE6OF01CTA9G.10.53.E09.1.454.CMB.1.raw
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacgaggacatcgtgatgacccagtctccagacctccctgcctgtgtctctgggcgagagggccaccatcaactgcaagtccagccagagtgttttatcagctcgacaataagaactacttagcttggtaccagcaagaaaccaggacagcctcctaagctgctcatttacnggcatcgtacccgggaatccggggtccctgaccgattcagtggcnggcgggtcgtgggacagtatttcactctcacatcagcagcctgcaggctagaagactggccgtatagtttatacgtgtcagtactatattactaccgtaccctatcaactcgttcccggacccgtacgggaacctaaaggtcggaacgtaactacgaaaacgtcgtggtacgg

SEQ ID NO: 58976 - DNA, 711 bp, Homo sapiens
  misc_feature: GYAE6OF01ERRIX.10.53.E09.1.454.CMB.1.raw
  modified_base (311)..(311): a, c, t, g, unknown or other
  misc_feature (311)..(311): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagtagtgtttttatcagctccgaacaataagaactacttagcttaggacagacaagaaaccaggacagcctcctaagctgctcatttacngggcagtctaacccgggaactcccggggtccctaggaccgtattcgaggtggaccgagggccgggttcgtaggggactaggtacttttccgaaccttcctaccgaccctagtccgagcaacgcctacgccgaggacctaggaaacgtacgtacggccggtacttaaggttttactaacgtttggtaccgtaacggtacccttaaactttaacgtttaacgttaacccggttaaccccccttaagtttaccccgtaaccgttaaccggtttacccccggggtacccccgttaaacgggggaaaccccgttaaaaagggtcgggggtaaacctaaacggttaaaccccgtaaaaacccggttaaccgttaggggttaaccgggtccgttacggtaaaccccc

SEQ ID NO: 58977 - DNA, 601 bp, Homo sapiens
  misc_feature: GYAE6OF01A9V18.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcgggccgattcaccatctaccaaagacaatttgaagaacacgactgtttctgacaaatgaacagcctgagagctggaggacacggctgtgtattactgttcgtttgttctgacgtcggtacggggtaataccttcgagcgtacgtcggggccgagggccacccgtggtccaccgtcctccctcacgtccctaccgaacccgaacgggcccacgttccggtcccttccccccgtcggtcccacccccttcctcccgaaacgtaccgacctacccgttcggtacgggggcccaaccggcggtccccggg

SEQ ID NO: 58978 - DNA, 681 bp, Homo sapiens
  misc_feature: GYAE6OF01DH3WL.10.53.E09.1.454.CMB.1.raw
  modified_base (183)..(183): a, c, t, g, unknown or other
  misc_feature (183)..(183): n is a, c, g, or t
  modified_base (388)..(388): a, c, t, g, unknown or other
  misc_feature (388)..(388): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagtcttgggttttcctcgttgcttcttttaagnggtgtccagtgtcaggtgcagcgtggtggagtcgtgggggagcgtggtccagccgtgggacgtccctgagacctctccgttgtttacgcccttcgtggtactttccacctttcgaagttagttacttcctttgcctacgttcgggtccctcgacggtcctccgaggccgaaggggtctgggaggtggggtcgactagttactctntagtttgagtggaataactaaataaactactacgaagacgtaccgttccgggtcgggaccgtacttaccacctactacctaaccaaacgtaactaaagtttagaaacgaacgtacgtacgttacgtttactagaactaaagtacgaacacgaccgtaggacgtacgacgtaggaacggacgacggtcgttagtagttaacgttacgtttcggtttcggttttacggttcgttacggtaccggttaccgggttaacggggttaacttacccgttacgacggtccgtaaccgggg

SEQ ID NO: 58979 - DNA, 548 bp, Homo sapiens
  misc_feature: GYAE6OF01CAH1K.10.53.E09.1.454.CMB.1.raw
  modified_base (310)..(310): a, c, t, g, unknown or other
  misc_feature (310)..(310): n is a, c, g, or t
  modified_base (335)..(335): a, c, t, g, unknown or other
  misc_feature (335)..(335): n is a, c, g, or t
  modified_base (397)..(397): a, c, t, g, unknown or other
  misc_feature (397)..(397): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagaggccaccatcaactgcaagtccagccagagtgtttatcagctccgacaataagaactacttagcttggtaccagcagaaaccaggacagcctactaagctgctcatttacnggcatctacccgggatccgggtccngaccgattcagtggcagtgggtcgtggacagacttcactctcaccatcagcagacgtggacncgtagaagtagttttcgctagttagttattacgtgtacgagtctagttagtcgggtcgccccggtcggtccgttcgtaggtttccgggcgggtacgggaaccgtagggttgaacgtagtaccgaaacggtaacgttcggtcggtctaccgg

SEQ ID NO: 58980 - DNA, 516 bp, Homo sapiens
  misc_feature: GYAE6OF01BASL7.10.53.E09.1.454.CMB.1.raw
  modified_base (398)..(398): a, c, t, g, unknown or other
  misc_feature (398)..(398): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaccaggacagcctcctaagctgctcatttactggcatctacccgggatccgggtcctgaccgattcagtggcagcggtctgggacagatttcactctcaccatcagcagcctgcaggctgaagntgcggctagtttatactgtacagctacttattactagtaccccattccactacgttccggcccttagggaacctaaaggtcggaacgataccgaaacgaactaggcggtctcgtaacc

SEQ ID NO: 58981 - DNA, 574 bp, Homo sapiens
  misc_feature: GYAE6OF01EV9SH.10.53.E09.1.454.CMB.1.raw
  modified_base (419)..(419): a, c, t, g, unknown or other
  misc_feature (419)..(419): n is a, c, g, or t
  modified_base (450)..(450): a, c, t, g, unknown or other
  misc_feature (450)..(450): n is a, c, g, or t
tcagcatagtagtgcacgaccggtgctcgatttagagagagtgtgttggggtttgggggagctacaacaggcaggcaggggcagcaagatggtgttgcagacccaggtcttcatttctctgttgctctggatctctggtgccgtacggggacatcgtgatgacccagtctccagacctccctgcctgtgtctcgtgggcgaggacgggccaccatcaactgcaagtccagccagagttgttttatcagctccgacaataagaactacttagcttcggtaccagacaagaaaccaggaccacgcctacctaagctgctactatttacgtgggactacgtccgtaacccgggaactcccggggtaccctgaccgtattcaggtggcaggcgggtcgtgggacagtactttcactctcaccntacagcagctgcaggctagaagatcgcggtntagtttacttactgtcagcctaattattactaccgtaccctattaccacttacgttcccggacccgttagggaaccctaaagggtaggaacgtactaacgaaaaccggtacgtggtcggtaccg

SEQ ID NO: 58982 - DNA, 571 bp, Homo sapiens
  misc_feature: GYAE6OF01BVGG2.10.53.E09.1.454.CMB.1.raw
  modified_base (317)..(317): a, c, t, g, unknown or other
  misc_feature (317)..(317): n is a, c, g, or t
  modified_base (438)..(438): a, c, t, g, unknown or other
  misc_feature (438)..(438): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgaggagggccacatcaactgcaagtccagccagacgttgttttatcagctccgaacaataagaactacttagcttggtaccagcaagaaaccaggacagcctcctaagctgctcatttacngggactacgtccgtaacccgggaactcccggggtcctggacccggtattcgaggtcggcgacggcgggtctgggacagtacttcactcgtcactatcagcgacgcctgcgaggtctgaagngcggtcgcgtaacgttttatacgtgtcgagaccttagttattacgtacgtaccctattccaacgttacgtcggtacccgtacggaacccgtaaaggtcggaaacgttacaacgaaaccgtacgtggtgtaccg

SEQ ID NO: 58983 - DNA, 676 bp, Homo sapiens
  misc_feature: GYAE6OF01C6W37.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacggggacatcgtgatgacccagtctccagactccctgcctgtgtctctgggcgagagggccaccatcaactgcaagtccagccagtagtgttttattcagctccgaacaaataagaactacttagcttgtaccagacaagaaaccaggacacgcctaccaagctcgctctaatttacgtgggctaacgtccgtaacccggggtaacgtcccggggtaccctacggtaacccgtattcgaggttcgggacgtacggcgggttacgtcggggaactaggtactttcacttcctaccaacctatacagtccacggtcctaggccgaaggtcctaaggaacgtagtcgggaccggtacgtttaagttttaacgttacgttacggtacaacggtaccttaacgttaatttacgtaacccgttaacccccttaagttaccctaaaccgttaccgtttaccccgggaccccgttaacggggtaaacccctaaaaggtagggtactaacgtaaaccgaaacgtaaacgtgggtacggtac

SEQ ID NO: 58984 - DNA, 584 bp, Homo sapiens
  misc_feature: GYAE6OF01BC3BU.10.53.E09.1.454.CMB.1.raw
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
  modified_base (572)..(572): a, c, t, g, unknown or other
  misc_feature (572)..(572): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcattttgatggagacaataaatactaacagacgactccggttcggggcgtattcaccatctaccaaagacaatttgaaagaacacgctagtttcngactaaatgaaacagcctgagagctgaaggacacggntgtgtattactgttcgttgttctgtactcggtcgggaagttaccttcgacgtcacgtcggggccaagggctaccgtcggtctaaccgtcctcctcctacgccctaccacccgtacggccctagtccgtccttcccccgtcggccctacccctcctacccgagaccgcctaccgtcgtcggggccncgcggtacccgg

SEQ ID NO: 58985 - DNA, 716 bp, Homo sapiens
  misc_feature: GYAE6OF01EA250.10.53.E09.1.454.CMB.1.raw
  modified_base (184)..(184): a, c, t, g, unknown or other
  misc_feature (184)..(184): n is a, c, g, or t
  modified_base (346)..(346): a, c, t, g, unknown or other
  misc_feature (346)..(346): n is a, c, g, or t
tcagcatagtagtgcacgaccggtgctcgatttagagagagtgtgttggggtttgggggagctacaacaggcaggcaggggcagcaagatggtgttgcagacccaggtcttcatttctctgttgctctggatctctggtgccgtacggggacatcgtgatcgacccagtctccacgacctcccngcctgtcgtctcgtgggcgaggacggccaccatcaactgacaacgtccagccagtagttgttttatcgacgctaccgaacaaataacgtaactacttagcttacggtacagacaacgaaaccgaggaccacgccctaccgtaagctgtacctatatttacgnggactacgtaccgtacccgggtaacgtcccgggtaccctacgtaaccgtattcgacggtcggactacggcgggtacgtagggaactagttacctttacaacctccgtaccaacctagtaccgacgaccgacgtcccgtacggaccgacggttaccgtaaacggaaggtccgtaacgggtacccgggtttaacttaagggtttttaacttaaccgttcggtaaccacggtttaacctaacgtttaattaacggtaccctaaccccgttattacccgaagttacccgggttacccggtaaccggtacggggtaaacctaaagggtacggtaaacgtagttaaacccgaaaacggttcgtaggtacggtaccg

SEQ ID NO: 58986 - DNA, 592 bp, Homo sapiens
  misc_feature: GYAE6OF01CA54T.10.53.E09.1.454.CMB.1.raw
  modified_base (157)..(157): a, c, t, g, unknown or other
  misc_feature (157)..(157): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (499)..(499): a, c, t, g, unknown or other
  misc_feature (499)..(499): n is a, c, g, or t
  modified_base (560)..(560): a, c, t, g, unknown or other
  misc_feature (560)..(560): n is a, c, g, or t
  modified_base (581)..(581): a, c, t, g, unknown or other
  misc_feature (581)..(581): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtggggggaggcgtggtccagcctgggaggtccctnagactctcctgtttagcctctggattcacttcagtagttatcctttgcactgggtccgtcaggctccgaggcgaaggggctggaggtgggtgcagttanctntattgatggagacgaaataaatactaacagagacttccgtcgggcgattcaccatctacaaagactaagtttgaaagaacacgtcttgttactgacaaatagaacagtcctagaagtacgactggacgacgacgtcgtgtgttattacgtgtttcgttgtctagtacgtcggtacgggaactacctcgagtcgacgtcgggcgacggccgtaccgtcggtccaccgttctccctacgacncccttaccaaccgacggccctagttccgtccctcccgtacggccctaccctctcccgaacncgactaccgtcggtacgggcncgacgtcccgg

SEQ ID NO: 58987 - DNA, 865 bp, Homo sapiens
  misc_feature: GYAE6OF01A8STX.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagccgtgggacggtccctcagacctctcctgtttacgcctctggattccaccttcaagttagttacttcctttgctacgtgggtcctcgaggcctccgaggcgaaggggcgtagggacggttggggtggacgtagttactctcgtagttttgagttaggaagtaactaaaattaaactactaacgaggaacgtaccgttcccgggttccggggacctacgttaccaacctacgttacctaaccgtaaaagtaattaaagtttacggaaaacgaaactacgtcgtttacgtttacgacgtaactaaaagttacgaaacgtacggtaccgtaggaacggtacggtacggtaggaaccgggtaaccggtaccgggttacttacgggttacgtttaaccgtttttaacggtttcgggtttttaccggttttcgggtttacgttaccgggttaccggttaccggggttaacggggtaaaccctttaccgttaccgacggtaccggttaccgggtcggggtacccgaccgggtccccgttaccggtcccggtacctcccgttaccctccgtaccgtacccgtccccgtacccgaaccggtaccggaccccgtacgttccccgtccccgttccccggtaccggtcccctaaccccgttaccctacccgaaccgtcccgtacccgtaccccggtaccgggtaccggggacctacccgggtccgggtaccccggg

SEQ ID NO: 58988 - DNA, 935 bp, Homo sapiens
  misc_feature: GYAE6OF01BKN9Q.10.53.E09.1.454.CMB.1.raw
  modified_base (157)..(157): a, c, t, g, unknown or other
  misc_feature (157)..(157): n is a, c, g, or t
  modified_base (296)..(296): a, c, t, g, unknown or other
  misc_feature (296)..(296): n is a, c, g, or t
tcagcatagtagtgcacgaccggtgctcgatttagagagagtgtgttgggtttggctgagcttgggttttcctcgttgcttcttttaagaggtgtccagtgtcaggtgcagctggtggagtcgtgggggagcgtggtccagccgtgggacgtccctnagacctctcctgtttacgcctctggactttccacctttgaagttagtttacttcctttgcctacgttcggggtccctcacggtcctacccgagggaccgaaagggggtcctagggaggttggggtggcctagttatctntagtttgatggaagaacaaataaatactacagacgaccgtccggttacgggcctacttccgacctactcctaccaaagtactaaatttagaaacgtaacaccgtcgtttacgtttcgtacgtaactaaaacgtacgaaaccgacgtacccgttaggaacgtacgacgtaaggaaccggacgtaccggtacgttacggttacgttaacgtttaccgtttggttttccggtttttacgggtttccgttacggttaacccggtttccggggtaaaccgggggttaaaccttaaccccgtttacggtaaccggtcccgtaacgggttcccgggggaaccgtaccggggtacccctacccccggttacggggttaccctacccggtttaaccctcccggttacccgtaccccggttacccgtacccccggtaaacccggtaacccggggtccccgtttaacccggtcccccgggttttaccccccgttaccccccccggttaccggggtaccccccttaacccccccgttacccccgggttaaacccccgaaaccgggtaccccggttaaccccgttaacccccggttacccgggggttaacccggggcccccgtaaaccggtaccccggggtccccccggggg

SEQ ID NO: 58989 - DNA, 588 bp, Homo sapiens
  misc_feature: GYAE6OF01CAVTB.10.53.E09.1.454.CMB.1.raw
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagagttgttttattcagctccganaataagaactacttagcttagtaccagacagaaaccaggacagcctacctaagctgctactatttacgngggcagtccgtacccgggaagtcccgggtacctcgaccgtattcacggtggcaggcgggtcgtagggactagtactttcactctaccacctatccacgcacggtcctggaccgaggtctaggaacgatcgggccggtcttaagttttacttactcgtacgacgtctaacttattacgttaccgtacccctattcccaacgtacgttccggtaccgtacgggtaaccgtaaaggtggaacgtactacgaaacgtactggtacggtaccg

SEQ ID NO: 58990 - DNA, 664 bp, Homo sapiens
  misc_feature: GYAE6OF01EH3QY.10.53.E09.1.454.CMB.1.raw
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
tcagcatagtagtgcacgaccggtgctcgatttagagagagtgtgttggggtttgggggagctacaacaggcaggcaggggcagcaagatggtgttgcagacccaggtcttcatttctctgttgctctggatctcgtggtcgccgtacggggacatcgtgatcgacccagtcctccagtacctcctgcctgtgtctcgtgggcgaggacggccacatacaactcgacaacgtccacgccgaagtaggtttagttttaactcgacgtccgtaccgaactaaataaacgaaccttacgttacgcgtttacggtaccaagacaaacgaaaccgaggaccacgtacctaccgtaagtctcgcttactagttacgnggactacgtacccgaaccgggtacgtcccgggtctgaccgtatcgaggtggcgnggtcgggtgtacggactagtcttcactctcacctagcacgctacgccgtgacgtaggtctaaggacgnggtacggcgttaccttaagttttcacggtacgtacgttacgacttaacttacgtttaaccgaccgttaccctagttacctaaccggttaccgtccccggtacggttaaccgggaaacgtaaacgggttcggaaacgttaccgaaacgtaaacggcgttcgggcgtaacccg

SEQ ID NO: 58991 - DNA, 747 bp, Homo sapiens
  misc_feature: GYAE6OF01DRJRJ.10.53.E09.1.454.CMB.1.raw
  modified_base (335)..(335): a, c, t, g, unknown or other
  misc_feature (335)..(335): n is a, c, g, or t
tcagcatagtagtgcacgaccggtgctcgatttagagagagtgtgttggggtttgggggctctgggagacgagcccagcactggaagtcgccggtgtttccattcggtgatcatcactgaacacagaggactcaccatggagtttgggctgagcttgggttttcctcgttgctcttttaagaggtgtccagtgtcaggtgaagctgggtggagtcgtggggggaggcttggtcaagcctgggacgggtccctgacgactctcctgtgcagcctcgtggacttccgccttcgtggattgacgttcagtcgacttactacagtcgaccgtgggtccncaggcctccgaggggaagggctggagtggttcatactatttatctaggtgtagactacattatactacgcagtactcgtaggtcggaaacggggtccctaagtttacccaacctacgttaccctacccggaacggggtaacccaaaccggaccccgaaaaggtaaccccttcctaaacggttacgttaaccgtttttacgaaaccgtaaaacgttaccggaaaacccctaaccccgtcgggaacccgggtaaccggaccccggggaaagggtaaccccgtaaccggggtaaccccgtttaaatttaacgtttaacccggtagggttaccgggaaccggttaaaaccggttaaaacccggtttaaccccccgggttttcccgtacccgggtttttacggggttttaaaacccc

SEQ ID NO: 58992 - DNA, 574 bp, Homo sapiens
  misc_feature: GYAE6OF01B7X77.10.53.E09.1.454.CMB.1.raw
  modified_base (317)..(317): a, c, t, g, unknown or other
  misc_feature (317)..(317): n is a, c, g, or t
  modified_base (415)..(415): a, c, t, g, unknown or other
  misc_feature (415)..(415): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctgcctgtgtctcgtgggcgagcgggccaccatcaactgcaagtccagccagtagttgttttatcgacgctaccgacaataagaactacttagctgtacagcagaacaggacacgcctcctaagctgctctatttacgnggacactcgtacccgggaactcccggggtcctggaacccgtagttacaggtcggcacggcgggtcgtggacagtacttacactctacgaccatacacncgagcctgcgacggctagaacgagtcgacggactagtttactacgtgtaccaggtacaacttacgttactaccgttaaccctattacccacgtacgtttccgggaccgtacgggaaccaaggtcggaataacgacgaaacgttacgtcggtggtacccg

SEQ ID NO: 58993 - DNA, 744 bp, Homo sapiens
  misc_feature: GYAE6OF01B1LEN.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctcgtggtgccgtacggggacatcgtgatcgacccagtcctccagacctccctgcctgtgtctcgtgggcgaggacggccacatcaactgacaacgtccagccagtagtttgttttactacgagtcctaccgaactaaataacgtaacttacttagtctttacggaccagaccaacgaaaccgaggaccacgtcctacgtaacgctcgcttactacgtttacgcggacctacgttacccggtaaccgggtaccgtcccgggtacctacggaccgtacgttacgaggtcggaccggtacgggtcgggtacgtacgggaactagttacttccacgtcctaccgactagtaccgacgtaccaccggtcctacggaccgtaggaccgtaaggaacgtacggtacgggtaccggtttaacgttttaacgtttttaaccgtacggttacgtaaccggtaacgtaacctttaaacgttaactttaaacccgtacccgtaaccccctagtttaaccgtaccgttacccgggtttaccccgggaaccgtaaacggggtaaaccgaagggttcggaaacttaacgaaacccggtaaacggtcgttacgggacgtcgttaccgaacccg

SEQ ID NO: 58994 - DNA, 585 bp, Homo sapiens
  misc_feature: GYAE6OF01ELNAY.10.53.E09.1.454.CMB.1.raw
  modified_base (312)..(312): a, c, t, g, unknown or other
  misc_feature (312)..(312): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgacaagtccagccagagtgttttatcagctccgacaataagaacttacttagcttaggtaccagcaagaaaccaggacagcctcctaagctgctcatttacgnggcatccgtacccgggagtcccgggtcctggaccgtattcgaggtcggcgaggtcgggtcgtggggactaggtacttttccgacctctaccaccctatcagcacgcctgcgaggctagaagagtgcggtactagtttattacgtgtacagactaacttattactacgtacccctattccgacttacgttccggaccccgttacgggaaccctaaaggtcggaacgtaactaaccgtaaaaccggtaacgttaggtacgggtccgtcgtaaccc

SEQ ID NO: 58995 - DNA, 552 bp, Homo sapiens
  misc_feature: GYAE6OF01A69AA.10.53.E09.1.454.CMB.1.raw
  modified_base (249)..(249): a, c, t, g, unknown or other
  misc_feature (249)..(249): n is a, c, g, or t
  modified_base (348)..(348): a, c, t, g, unknown or other
  misc_feature (348)..(348): n is a, c, g, or t
  modified_base (542)..(542): a, c, t, g, unknown or other
  misc_feature (542)..(542): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggaggcgtggtccagccgtgggacgtccctnagactctcctgtttagcctctggattcaccttcagtagttatcctttgctactgggtccgtcaggctccgaggcaaggggctggagtgggtgcagttanctcatttgatggagacaataaatactacagaagactccggttcggggccgattcaccatctaccaaagactaatttagaagaacacgcttgtttcagacaatgaacagacctagagtagctgaggacacggctgttagtagttacgtcggtttcgtttggttcttggtacttcgggtacggggtacttaccgtnacgcgtacgg

SEQ ID NO: 58996 - DNA, 660 bp, Homo sapiens
  misc_feature: GYAE6OF01CA4FC.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctgggagtggggtggcagttatctcatttgatggagacaataaatactacagagactccgttcggggccattcaccatctaccaaaagactaatttgaaagaacacgcttgtttctagacaaatgaaacagccctgagagcgtagacggacacggcttgtagttattacgtgtttcgtttggttctggtacgtcggtacgggggtaacttaccgttacgacgtccgtacggtcggggacccgaggggtccctacccgttcgggtacctacccggttcctcccgtacgtaccgtcccctacccgaacccgaaccgggcccctaacgttcccgttccccgttccccccgtcggtcccctacccctcccgtacccaacggaccgaccccgtacccgtacgggtacgggggccaccggtcggcccccgggg

SEQ ID NO: 58997 - DNA, 663 bp, Homo sapiens
  misc_feature: GYAE6OF01CUWU3.10.53.E09.1.454.CMB.1.raw
  modified_base (260)..(260): a, c, t, g, unknown or other
  misc_feature (260)..(260): n is a, c, g, or t
  modified_base (335)..(335): a, c, t, g, unknown or other
  misc_feature (335)..(335): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctgcctgtcgtctcgtggggcgaggacgggccacatcaactgacaagtccagccagtagttgttttatcagctaccgaanaaataacgaactacttagcttacggtaccagacaagaaaccaggacacgcctacctaagctgctactatttacgngggacacgtaccgtaaccgggtacgtcccggggtacctacggaccgtattccggaggtcggacgacgggtcgggttcgacggggactacggtactttccaccgtcctacaaccgatcgacgacgtacgccgtgaccgtagggctaggaacgtagtcggacggtaccttaaggtttactacgttcgtaaccgaaggtacctaacttacgttaacaacccgttaccccgttatacccgtaaccgtacggttaccccgggtacccgtaacgggaaaccctaaagggtcggtaaacgtactaaaccggaaaaccgtcgttgggaccgtaccg

SEQ ID NO: 58998 - DNA, 654 bp, Homo sapiens
  misc_feature: GYAE6OF01BD0IO.10.53.E09.1.454.CMB.1.raw
tcagcatagtagtgcacgaccggtgctcgatttagagagagtgtgttgggtttgggctgagctgggttttcctcgttgctctttaagaggtgtccagtgtcaggtgcagctggtggagtctgggggaggcgtggtcccagcctgggaggtccctcagactctcctgtttagcctctggattcaccttcagtagttatcctttgcactgggtcctcaggctccaggcaaggggctggagtgggtgcagttatctcatttgatggagacaataaatactacagagtactccggttcgggaccattcacctatcctaccaaaagtacctaatttagaaagaacacgtacttgttactgacaaatgaacagcctgagagctagaggacacggctgtagttattacgttgtttcggtttggttcgtaggtaccgttacgggtacggggtaacttaccgttacgacgtaccgtaacggtcggggaccgacgggtcctaccccgttcgggtaccgtacccgttacctcccgtaccgtaccgtcccctacccgaacccgaaccgggcccctacgttcccggttcccttcccccgtcggtccctaccccgtccctaccgaacgccgccctaccgtcggtacggggccaccggcggtccccggg

SEQ ID NO: 58999 - DNA, 777 bp, Homo sapiens
  misc_feature: GYAE6OF01CAUHZ.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacggggacatcgtgatgacccagtctccagactccctgcctgtgtctcgtgggcgaggaggccaccatcaactgacaagtccagccagagttgtttatcgagtctaccgaacaaataagtaacctactttaacggctttagggtaacccagtaccaaacggtaaaacccgagggaaccacggtcccttaccgttaaaaggccttacggaccttacgttaacgttttaccggagggtacctaacgttacccggtaacccggggtaaaccgttccccggggttaccctaggtaaccccggtatttccgaaggttcggaccgtaggtccgggttacgtaggggtaaccaggttacttttccaaccgttacctacgtaacctacgtaccacgtaccgtaacgtccctacggaccgtaacgggtacgtacggaaacggtacgtacggtaccggtacctttaacggttttaacgtttaacgtaccgtacgtacggtaccttaacgtttaacgttactaaccgttacccctaagttacccaacgttaccgttacccgggtacccgtacgggtaaacccgaaagggttaccggtaaacgtaacgttaaacccgaaacgggttaacccttggtccggtaaccg

SEQ ID NO: 59000 - DNA, 621 bp, Homo sapiens
  misc_feature: GYAE6OF01BH3WH.10.53.E09.1.454.CMB.1.raw
  modified_base (237)..(237): a, c, t, g, unknown or other
  misc_feature (237)..(237): n is a, c, g, or t
  modified_base (340)..(340): a, c, t, g, unknown or other
  misc_feature (340)..(340): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatgacccagtctcagacctcctgcctgtgtctcgtgggcgagacggccaccatcaactgacaagtccagccagtagttgttttancgagcctaccgaacaaattaaacgaaccttacttagcgtttacggaaccagacaaacggaaaccaggacctacgcctacgtaagctcgactactagtttacgngggactacgtccggtaaccgggacgtcccgggtacctagacgtacttgaaggtcgcgaacggtcgggttcagggactagtacttccaactcgtaccacacgtccgacgctacgcctggaccgaggtaccgtagaagtgtacggtcggactttagttactacgcgtactaacgactaacgtttaatacgtacctaaccctatacgtacctcggtacccggtacgaacggtaaccaaggacggactaacttaaccgaaaacgttcgtacggagcgttccaaac

SEQ ID NO: 59001 - DNA, 612 bp, Homo sapiens
  misc_feature: GYAE6OF01A5750.10.53.E09.1.454.CMB.1.raw
  modified_base (540)..(540): a, c, t, g, unknown or other
  misc_feature (540)..(540): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggcctccaggcaaggggctgggagtgggtggcagttatctctatttgatggagacaaataaatactacagagacctccggttcggggccattcaccatcctaccaaagactaatttacgaaagaacacgtcttgtttacgtagactaaatacgaacacgccgtagagagcgtgaaggacgacggtctaggtagttatttacgttgtttcgtttgttcgtgtacgtcggtacggggtaactaccgttcacgccgtacgtcggggaccgacgggtccacccgtcggtacctaccgtcctccctcacgcctaccgaccacggcccncgtccgtcctccccgtcggtccctaccctcctaccaacgacgacctaccgtcgacggggccacgcggcccgg

SEQ ID NO: 59002 - DNA, 1014 bp, Homo sapiens
  misc_feature: GYAE6OF01CYKJ3.10.53.E09.1.454.CMB.1.raw
tcagcatagtagtgcacgaccggtgctcgatttagagagagtgtggttgggttggggacaacaggcaggcaggggcagcaagatggtgttgcagacccagtcttcatttctctgttgctctggatctctggtcgccgtacggggacatcgtgatcgacccagtcctccacgtactccctgcctgtgtctcgtgggcgaggacggcccaacctataccaaacgtgactaacgtccagaccagtagtttagttttaatcagtacctaccgaaactaaagtaaacgtaaaccttacgttaagtccgtttacgggtaaccaggaccgtaaaacggaaaacccgacggaacctaaccgtacccgttaaccgtaaagtccgttacggaccgttaccgtaagttttacgtcggggtaacctaacgtacccggtaaaccccggggtaacggttcccggggtaccctacggtaaccgtactttacgaacggtcgacgtacgggtccggtacgtacgggaactaggttaccttttaccgaacccgtttccgtaaccgtaacccgtaagttaccgtaacgtaccccgtaaccggtacccggttacggaacccggtacggggttaccgtaaacggggtaaacggttaaacgggtccggggttaacccggttaaccgttttaaaccgggtttttaaccgttttaacccggttaccggtttaaccccggtaaacgggtttaaccccgtttaaaacggttttaaacccgttttaaacccggttaaaaccccccggttttaacccccccgttaaagttttaaacccccggtaaaccggttaacccccgggttttaccccgggggtaaaacccccgggtttaaccgggggttaaaaaacccccgtttaaaaggggggtttaaccggggttaaaacccggttaaaacccgtttaaacccgggtaaaaaaaccccggttttaacccggggtcggtttaaacccggggtacccgtttaacccgggtaaaccccg

SEQ ID NO: 59003 - DNA, 762 bp, Homo sapiens
  misc_feature: GYAE6OF01CHDQG.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctggattcaccttcagtagttattcctttgctacgtgggtccgtcaggctccgaggcgaaggggctgggaggtggggtggctagttatctctagtttgagtaggaagaacaaataaaactaactaacagacgacgtccggttcggggccgattcaccactctaccaaaagactaagtttacgaaagaaccgacgtcttgttctagaactaaagtcgaaacacgccgtaggagacgacgtaggaacggacgacggtcttaggtacgtttacgtttacgtttacggttttcggttttacgggtttcgttacgggtaccggttcggggttaaccgggggtaaaccttacccgttacgacgtccggtacggtaccggggaccgtacgggtcccgtacccggttcggtacccgtacccgtccgtccccgtaccgaccgtcccctacccgacccggaaccggtcccgtacgttccccggttccccgttccccggtaccggtcccctacccccgttacccgtacccggaacggtacccgtacccggtacccggtcggggtaccgggggacccaccgggtccgggtaccccgggg

SEQ ID NO: 59004 - DNA, 519 bp, Homo sapiens
  misc_feature: GYAE6OF01A9T6H.10.53.E09.1.454.CMB.1.raw
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagntgcgcagtttattactgtcagcactacttatacgtacccctnttaccactacgttcggcccctagggacccaaagtggaagtactacgaaaccgaactgtcggtaccg

SEQ ID NO: 59005 - DNA, 704 bp, Homo sapiens
  misc_feature: GYAE6OF01C31XF.10.53.E09.1.454.CMB.1.raw
  modified_base (202)..(202): a, c, t, g, unknown or other
  misc_feature (202)..(202): n is a, c, g, or t
tcagcatagtagtgcacgaccggtgctcgatttagagagagtgtgttgggttgggggagctacaacaggcaggcaggggcagcaagatggtgttgcagacccaggtcttcatttctctgttgctcgtggatctcgtggtcgccgtacgggacagtcgtagatcgaccctagtcctaccagtacctccctgcctgtcgtctgngggacgaggcggccaccatacactgacagtccacgcagtagttgtttatccagcctaccgaactaaagtaacgtaacttacgtagtcgttacggtaaccagacaacggaaccgagacacgcctaccaagctcgtctactacttcgacggactacgtacccggtaaccgggtaccgttcccggtcctacggtaccgtagtcgacggtcggcgtacgggtcggtacggtaggtactacgtacttcctacctctaccaccgtatcgacgtcgacgtaccgtgacgtacggtacgtaggaaacgtgtacgggtcgtacgtttaagtttactacgtacgtacgtacgtacttaacgtttactacccttaaccgtaccccttacgttaccccgaacgttacccgggttaaccccgtacccgggtaaacggggtaaacccgtaaacgggtacggtaaacgtaccgtaaaacccgggaaaccgtacgggttccggtaccgggttaccccg

SEQ ID NO: 59006 - DNA, 680 bp, Homo sapiens
  misc_feature: GYAE6OF01D36NG.10.53.E09.1.454.CMB.1.raw
  modified_base (335)..(335): a, c, t, g, unknown or other
  misc_feature (335)..(335): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagactccctgcctgtgtctcgtgggcgagacgggccaccatcaactgacaagtccagccagagttgttttatcagctacgaacaataagaactacttagcgttacggtaaccagaccaagaaaccaggaaccaggccctactaagctacgctatacgtttacgngggacctacgtccgtaacccgggaacgtcccgggtccctagacccgtattacgaggtcgggctacggccgggtcgtagggaacctaggtaactttccgaacttcgtaccaccgtatcgagcaacgcctagtacgaggtcctaggaaacgtcgtcggtaccgggtacttaaggttttaacttaccgtcgtacgtacgtacctaacgttaacttaaccgtaccgtaaaccccctattaccgtaaccgttaccgttcccggggtaaccccgttacgggggaaaccctaaaagggttaggaaaccgtaacttaaacccggaaaaccggttaacgtggtacgggtacccg

SEQ ID NO: 59007 - DNA, 596 bp, Homo sapiens
  misc_feature: GYAE6OF01ANJDB.10.53.E09.1.454.CMB.1.raw
  modified_base (316)..(316): a, c, t, g, unknown or other
  misc_feature (316)..(316): n is a, c, g, or t
  modified_base (453)..(453): a, c, t, g, unknown or other
  misc_feature (453)..(453): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttggtaccagcaagaaaccaggacagcctacctaagctgctcaatttacngggacagtccgtaacccgggaacgtcccggggtccctcggacccgattcgaaggtcggacgaggtcgggtcgtgggacaggtactttcgaccttctacaccatcacgcacgcctgcaggctagaagactggacggtntaacgttttataacgtggtacagtcctaacttaacttacgtaccgttacccctatttccgaacttaccgttccgggaccccttaggggaaacccaaaggtcgggaaacgtactaaccgaaaacggtaccttggtacggtaccg

SEQ ID NO: 59008 - DNA, 673 bp, Homo sapiens
  misc_feature: GYAE6OF01BASWA.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttggtaccagcagaaaccgaggacagcctactaagctgctactattttactgggcacgtaccgtaccccgggtaacgtcccggggtccctcggaaccgtactttcgaacggttgggccgaggtccggggttccgttaggggaccaaggtactttaccgacctccgtaccaccattccgaagtccacggcccgttgacgacggtctaggaaaggtacgtcggtacccgggtacttaggttttaacttacgttagtacctaaccggtaccttaattaactttaacgtaaccgttaaccccctagttcccaacgttaccgttcccgggtaccccgtacggggtaacccgaaaggttcgggaactaaacgtaaccgaaaacccggtaacttagggtacggtccgtacggtaacccc

SEQ ID NO: 59009 - DNA, 591 bp, Homo sapiens
  misc_feature: GYAE6OF01DYXAB.10.53.E09.1.454.CMB.1.raw
  modified_base (319)..(319): a, c, t, g, unknown or other
  misc_feature (319)..(319): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagacggccaccatcaactgacaagtccagccagagttgtttatcagctccgaacaataagaactacttagcttggtaccagcaagaaaccaggacagcctactaagctcgctctagtttacngggcactccgtacccgggaacgtccgggtccctgacccgattcgagtggcaggcgggtctgggacagtactttcgactcgccaccatacgagtcaacgccgtcgacgacggtcctaggaagtcgtggcggtactagttttactactgtacagtacctaacttatttacgtaccgttaacccctagtccaacgtcgttacccggacccgttaagggaacccgtaaaggttcggaaacgtacgttaaacgaaaccggtacgttggtcggtaccg

SEQ ID NO: 59010 - DNA, 618 bp, Homo sapiens
  misc_feature: GYAE6OF01AYDCS.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgttagcctctggattcaccttcagtagttatcctttgcactgggtccgtcaggctccgaggcaaggggctgggagtgggtggcagttatctcatttgatggagacaataaatactacagagactccggttcggggccgattcaccatctccaaagacaatttgaagaacacgctgtttctgacaaatgaacagcctgagagctgaggacacggctgtagtatttacgtgtttcgtttggttctgtacgtcggtcggggtaataccgttcgagctacgtggggccgacgggcacccgtcgggtccacccgtctccctcgacgtccctaccgacccgaacgggccctacgttccggtcccttcccccgtcgggtcccctaccccgtccctcccgaaacgtaccgcccaccccgttaccggtaccggggggaccaacccggcgggtacccccgggg

SEQ ID NO: 59011 - DNA, 575 bp, Homo sapiens
  misc_feature: GYAE6OF01AXJBH.10.53.E09.1.454.CMB.1.raw
  modified_base (318)..(318): a, c, t, g, unknown or other
  misc_feature (318)..(318): n is a, c, g, or t
  modified_base (444)..(444): a, c, t, g, unknown or other
  misc_feature (444)..(444): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagtagttgttttatcagcctccgacaataagaactacttagcttggtaccagacaagaaaccaggacacggcctacctaagctgctctaatttacgngggcagtccgtaacccgggaagtcccggggtccctcggaaccgtattcgaggtcggcgaggtcggggtcgtacgggactagtactttcacctctaccaccatcagcacgcctgcaggctaggaagntggccggacttagttttaacttacgtgtacagtactaacttaattactacgtaacccctattccactacgttccggacccgtacggaacaaaggtggaacgaactacgaaacgtactaggtgtcgtgaacc

SEQ ID NO: 59012 - DNA, 655 bp, Homo sapiens
  misc_feature: GYAE6OF01DP0AY.10.53.E09.1.454.CMB.1.raw
  modified_base (156)..(156): a, c, t, g, unknown or other
  misc_feature (156)..(156): n is a, c, g, or t
  modified_base (261)..(261): a, c, t, g, unknown or other
  misc_feature (261)..(261): n is a, c, g, or t
  modified_base (397)..(397): a, c, t, g, unknown or other
  misc_feature (397)..(397): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtgggtccagcctgggaggtccctnagactctcctgtttagcctctggattcaccttcagtagttatcctttgcactgggtccgtcaggcctccaggcaaggggctgggagtggggtggctagttatctnatttgatggagacaaataaatactacagagactccgttcggggccgattcaccatcctaccaaaagactaaatttgaaagaacacgcttgtttctagacaaatgaaacagcctagagagctgaggacacggctgtnttattactggtttcgtttggttctgtacgttcgggtacggggtaacttaccgttcgacgtcgtacgtcggggccgacgggccctaccggttcggtacctaacccggtcctccctaccgtaccgtccctacccgaaccggtaacgggcccctaacgtcccgggttccccttcccccgtcggtcccctaccccgtcccttacccgaacgtaccgcccgtaacccgtcggtaccgggggaccaccggacggtcccccgggg

SEQ ID NO: 59013 - DNA, 586 bp, Homo sapiens
  misc_feature: GYAE6OF01BXZMY.10.53.E09.1.454.CMB.1.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (563)..(563): a, c, t, g, unknown or other
  misc_feature (563)..(563): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtcctccagacctccctgcctgtgtctcgtggggcgaggacgggccaccatcgaaactgacaagtccagccagagttnttttatcagcctaccgacaaataagaactacttagcttaggaccagcaagtaaaaccnggacagtcctactaagctgtactctaatttacgtgggacaacgtccgtaacccgggaagtcccgggtccagacccgattcgagtgggctacgggcgggtcgtacgggaacaggtactttacactctcacagtcagcagcngcngnagagngtacgnggacttagtttactacgtgtactagtaccattaactactaaccgtaccctattaccaacgtcggttccggaccccgtagggaacccaaaggtacggactacgaanaaacccggtaatcggtaaggtcc

SEQ ID NO: 59014 - DNA, 647 bp, Homo sapiens
  misc_feature: GYAE6OF01EPEOJ.10.53.E09.1.454.CMB.1.raw
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
tcagcatagtagtgcacgaccggtgctcgatttagagagagtgtggttggggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagagttgttttatcagctccgaacaataaagaacctacttagcttaggtaccagcaagaaaccaggacacgcctcctaagctgctctatttacgtggactactccgtaacccgggacgtcccgggtcctacgaccgtattcgaggtcggcgacgggtcggggtctacggggactagtatttaccacttcctaccgacctatcaagcacgtcctggacnggacctaggaacgtagtcggaccgtnttaagtttttacgtacgttacgtccaagtaccttaacgttaacttaacttacccgttaacccctaatttacccaccgttaaccggtttcccgggacccgtaaacgggggaaacccaagggttaacggaaacgtaaccgaaacccgtaaaacgtaccgggttcggtaggtacccg

SEQ ID NO: 59015 - DNA, 634 bp, Homo sapiens
  misc_feature: GYAE6OF01C8NNF.10.53.E09.1.454.CMB.1.raw
  modified_base (378)..(378): a, c, t, g, unknown or other
  misc_feature (378)..(378): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggacccaccatggagtttgggctgagcttgggttttcctcgttgcttcttttaagaggtgtccagtgtcaggtgcagctggtggagtcgtgggggagcgtggtccagccgtggggacgtccctcagactctcctgttagcctctggattcaccttcagttagttactcctttgctacgtgggtcccgtcgaggcctccgaggcgaaggggctgggagtggggtggctaggttactctctagtttgatggaanaactaaataaatactaacgagtaacgaccgttccgggttcggggaccctattaccaacctactacctaccgaaacgaactaagtttagaaacgaacctacgtacttcgtttactacgtactaaatacgaactacgacctaggacgagcgtaggacggacgacggtctggttagttactttacgttgtttcggtttggttcgttcggtaccgttcgggttacggggttaacttacccttgacgtcgtcggtacgggg

SEQ ID NO: 59016 - DNA, 815 bp, Homo sapiens
  misc_feature: GYAE6OF01D4V0J.10.53.E09.1.454.CMB.1.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (801)..(801): a, c, t, g, unknown or other
  misc_feature (801)..(801): n is a, c, g, or t
tcagcatagtagtgcacgaccggtgctcgatttagagagagtgtgttgggttgggctgagctgggtttcctcgttgctctttaagaggtgtccagtgtcaggtgcagctggtggagtcgtgggggaggcgtggtcccagccgtggggacggtccctcagactctcctgtttacgcctctggattccaccttcagtagttactcctttgctacgtgggtcctcatgcctccgnggaaaaacgnggggtctgggagtggggtgctagttactcctgtatttgagtggaacgaactaaataaactactaacagacgtaccgtccggttccggggctacttccacctactaccgacccaaaagtactaaagtttagaaacggtaaaccacggtcttagtttcacggaacaaacgtgaaaccgacgtcctaggaacggtaaggcctaggaaacggaccgaaacggtcgttggttaacgtttacgtttacggtttacgggttttccggttttcgggtttcgttacggggtaaccgtttccggggtaacggggggtaaacttacccgttacgtaacgggtccgtaaaccggtccgggggaccgtaaccggggtaccctaaccccgggttcgggtacccgttaacccggtcctttaccccggtacgtacccggtccccgttacccgaacccgtaaccgggttaccccctagttccccgggttccccgttacccccggtcggtacccccctacccttaccccgtaccgtaaacggaccgtcccgaaccccgtacgggtccggggtacccnccggtaacccgggg

SEQ ID NO: 59017 - DNA, 633 bp, Homo sapiens
  misc_feature: GYAE6OF01BBKCF.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgaggacgggccaccatccaactgcaagtccagccagtagttgttttatcagcctccgaacaaataagaaccttacttagcttaggtaaccagacaacgaaaccaggaccacgcctacctaaagctgcctctatttacgcgggacacttccgtacccgggaagtcccggggtaccctacgaccgtattacgaggtcggccgtaggtccgggtacgtgggaacctagtactttaccgacttcctaccacctacgttccgacgacgacgccgtcgcgtacggctagaagtacgtcggacggtacttagtttacgttacgtcgtacgagtaccgtacttacttacttaaccgtaccctacttacctacgttacgttccgtaccgtacgggtacccgaaaggtacggacgtaactaaccgaacgtaacgtggtacggtaccg

SEQ ID NO: 59018 - DNA, 664 bp, Homo sapiens
  misc_feature: GYAE6OF01EFSZY.10.53.E09.1.454.CMB.1.raw
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatcgaccagtctccacgtcctccctgcctgtcgtctcgtgggcgaggacggccacctatccaacgtgaccaagtccagccagtgttgttttactcgacgctaccgaataataacgtaacttacgtagtcgttacggaccagacaacgaaccaggacacgcctacgtagtctgtctactattacgtggactacgtccgtaaccgggtacgtcccgggtcctacggacctgtcgaggtcggcgtacgggcggtcgtacggactagtcttaccacttccacgacctatcganacgcgtacnggacgngacgtaaggaactgtcggtacgtactttaaggttacctacggtgaccgtaactacgttaaccgttacttaacgtaccccgtaaccgttataacccgtacccgttacggttccccgggaaccggtaaccgggtaaacgtaaacgggttcggaaccttaaccgaacccggtaaaacggtacggtttcgggaacggtccctggtaaacccc

SEQ ID NO: 59019 - DNA, 630 bp, Homo sapiens
  misc_feature: GYAE6OF01BIPPU.10.53.E09.1.454.CMB.1.raw
  modified_base (346)..(346): a, c, t, g, unknown or other
  misc_feature (346)..(346): n is a, c, g, or t
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
  modified_base (482)..(482): a, c, t, g, unknown or other
  misc_feature (482)..(482): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtcgccgtacggggacatcgtgatcgacccagtcctcagacctcctgcctgtcgtctcgtgggcgaggcggccacctatacaactgacaagtccagaccagtagttgttttactcagtcctaccgaataaagtaagaacttacgtacgtcttacggtaccaaggcaaacggaaaccaggaaccacgcctaccaagctgctacatttacgnggactagtccgtaccgggaacgtcccgggtcctacggaccgtattcgaaggtcgacgaggcgtcgnggacagtacttcactctcaacgtntcagcacgcctgactaggctaagacgtagtcgaggtactaagtttntaactgtactagtaccttaagtaacttacgtaacccgtaccctagttacccaaccgtacggttacccggacccggttaagggaaacccttaagggtacgggtaaccgtaaacacccgtaaaaaccgggtacttcgggtaacccgtcgg

SEQ ID NO: 59020 - DNA, 695 bp, Homo sapiens
  misc_feature: GYAE6OF01DIX9E.10.53.E09.1.454.CMB.1.raw
  modified_base (265)..(265): a, c, t, g, unknown or other
  misc_feature (265)..(265): n is a, c, g, or t
  modified_base (348)..(348): a, c, t, g, unknown or other
  misc_feature (348)..(348): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctgcctgtgtctcgtgggcgaggacgggcccaaccatccaaactgacaacgtccagccagtagttgttttatcgagctaccgaanaaataaagaaccttacttagcttaggaccagacaacgaaaccgaggacacgtcctaccgtaagctcgtactactagtttacgngggacctaacgtacccgtaacccgggtaacgtcccgggtacctacggaccgtattcgaggtcggcgacgggtcgggtagtacgggactacgtactttccacttacctaccgaacctagtaccgacgtaccacgtcctacgacgtaggtccgtaagaagtcgtcggacggtactttaacggtttaactacgttacgtacgtacgtactaaacttacttaacgtaacccgttaacccctattacccgaacgttaccggttacccggtacccgggttaaacgggaaaacccgtaaagggtagggaaactaaccgttaaacgaaaccggttaaccgtggtaccggtacccg

SEQ ID NO: 59021 - DNA, 775 bp, Homo sapiens
  misc_feature: GYAE6OF01DBK79.10.53.E09.1.454.CMB.1.raw
  modified_base (345)..(345): a, c, t, g, unknown or other
  misc_feature (345)..(345): n is a, c, g, or t
  modified_base (592)..(592): a, c, t, g, unknown or other
  misc_feature (592)..(592): n is a, c, g, or t
tcagcatagtagtgcacgaccggtgctcgatttagagagagtgtgttgggttgggacaacaggcaggcaggggcagcaagatggtgttgcagacccaggtcttcatttctctgttgctctggatctctggtcgccgtacggggacagtcgtgatcgacccagtctccagacctccctgcctgtcgtctcgtgggcgaggacgggccaccatcaactgcaacgtccagccagtagttgttttactcgagcctaccgaacaaataacgtaacttacgtagtcttacggaaccagacaacgaaaccgaggaacacgtcctaccgtaacgctgcctactagtttaccgngggactacgttacccggtaaccgggaacgtcccggggtaccctggtaacccgactttccggaaggttcgggaccgtacggggtcccggggttcgtacgggaaccgttaaggttaccttttacctaaccttccctaacccaacccgttacgtaccgaaccgctaacccggcccgttacggacggtaacggccgttaaggaaagtacgtcgggaccggttaacgtttaagtttacgtacgttgtaaccncggtaacccttacgttaaactttaccggtaaccccttaaccccgtaactttacctaaccggtacccgtttaccccgggacccgggttaacggtaaaccccgtaaagggttacggaaacgttaaaccctaacccggtaaaaaccggtacgttaacgggtccggtaacgtacccgggttaaaccc

SEQ ID NO: 59022 - DNA, 767 bp, Homo sapiens
  misc_feature: GYAE6OF01CP8PO.10.53.E09.1.454.CMB.1.raw
tcagcatagtagtgcacgaccggtgctcgatttagagagagtgtggttgggttgggggagctacaacaggcaggcaggggcagcaagatggtgttgcagacccaggtcttcatttctctgttgctctggatctctggtgccgtacggggacatcgtgatcgacccagtcctccagacctccctgcctgtgtcctcgtgggcgaggacgggccaccatcaactgacaagtccagccagagttgttttatcagtctaccgaactaaataaagaaccttacgttacgtccgtttacgggtaaccaacgaccgtaaacgaaaaacccgaagggtaccaacggtacccctaccgtaaaacggtccttaggtaccttacttaacgtttttaccggcggggtacctaacgttacccggttaacccggggtaaccgttccccgggggtaccccttacggaaacccggttaacgtttaccgaacgggttcgggacgtaacggggtccggggttacgtacggggaactaggtacttttaccgaccttccgtaccaaccgtacttacgacgacaacggtcctacggacgacgggtctaggaacgtagtcgggtacggtacgtttaaacgttttacgttacgtacgtaccgtacgtaccttaacttagttaccgtaaccgtaaccctattacccgtacttaccggttcccggtaccggtaacgggtaaccgtaacggtacggaacgtaaactaacgaaaccgttcgtgggtacgtaccg

SEQ ID NO: 59023 - DNA, 616 bp, Homo sapiens
  misc_feature: GYAE6OF01CIQ99.10.53.E09.1.454.CMB.1.raw
  modified_base (325)..(325): a, c, t, g, unknown or other
  misc_feature (325)..(325): n is a, c, g, or t
  modified_base (362)..(362): a, c, t, g, unknown or other
  misc_feature (362)..(362): n is a, c, g, or t
tcagcatagtagtgcacgaccggtgctcgatttagagagagtgtgttgggttttcctcgttgctcttttaagaggtgtccagtgtcaggtgcagctggtggagtctggggggaggcgtggtccagcctggggaggtccctcagactctcctgtttagcctctggattcaccttcagtagttatcctttgcactgggtccgtcaggctccaggcaaggggctggagtgggtgcagttatctcatttgatggagacaataaatactacagagactcgtcgggccgattcacatctaccaaagacaatttgaagaacacgctgtttcngacaaatgaacagcctgagagctgagacacggctgtntattactgttcgtttgttctgtacgtcggtacggggtaactaccgttcgacgacgtacggtcggggaccgacgggcctacccgttcggtccgtacccgtcctcccgtacgacgtccctaccgaaccgaacgggcccctacgtacccggttcccttcccccgtcggtccctacccctccctacccgaacgccgccctaccgtccggtcggggcccaacgacggtcccggcccgtagggcctcggccgttaccggg

SEQ ID NO: 59024 - DNA, 818 bp, Homo sapiens
  misc_feature: GYAE6OF01DLY23.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtcgccgtacggggacatcgtgatcgacccagtcctccagacctccctgtcctgtcgtctcgtgggcgagacggccaccatcaactgacagtccagccagtacgttgtttatcgagtcctaccgaataaataacgtaacttacgtacgtcgttacggaaccagacaaacgaaccgaggacacgtacctacgacgactcgtctactactttacggtcgggacctacgttacccggtaacccgggtaacggtcccgggtaccctacggtaccgtacgttaccgagggtcggacggtcgggtccggggtacggtacgggacttaaacggttaccttttaccgaacctttacccgtacctaacccgtaactccgaacgtaccggtaaccgtcccgtggaaccggtaaccgggtacgtaacgggtaacggtacgttacgggtaccggtttacgtttaaacggtttacctttaacgggttcctaacgtaacggttaacctttaaccgtttaacgttaaacccgtttaacccccggtaaccttaaacccgtttacctaaacccggttaccgggttaaccccccgtaccggggtaaaccggttaaaccgggtaaacggttaaccggaagttaaacccgtaaaaccggtaaaccgggttaacgtacggtttaccggtacccgtacgttaaaccccg

SEQ ID NO: 59025 - DNA, 574 bp, Homo sapiens
  misc_feature: GYAE6OF01BHYBG.10.53.E09.1.454.CMB.1.raw
  modified_base (312)..(312): a, c, t, g, unknown or other
  misc_feature (312)..(312): n is a, c, g, or t
  modified_base (425)..(425): a, c, t, g, unknown or other
  misc_feature (425)..(425): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagtagtgttttatcagctccgacaataagaactacttagcttggtaccagcaagaaaccaggacacgcctacctaagctgctctatttacngggcagtccgtaccgggaacgtcccggggtccctcgaccgtattcgagtcgcgaggcggtctgggacagtcttacactctcaccatcgagcacgcctgacgaggctaggaagngtcggcggtacttagtttacttacgtgtaccagacctaacttattactaccgtacccctattccacttacgttcccggacccgtacgggaaccctaagggtggaacgtaactaaccgtaaacggtacgtaggtacggtctcggtaaccc

SEQ ID NO: 59026 - DNA, 633 bp, Homo sapiens
  misc_feature: GYAE6OF01BTZPR.10.53.E09.1.454.CMB.1.raw
  modified_base (347)..(347): a, c, t, g, unknown or other
  misc_feature (347)..(347): n is a, c, g, or t
  modified_base (458)..(458): a, c, t, g, unknown or other
  misc_feature (458)..(458): n is a, c, g, or t
  modified_base (529)..(529): a, c, t, g, unknown or other
  misc_feature (529)..(529): n is a, c, g, or t
tcagcatagtagtgcacgaccggtgctcgatttagagagagtgtgttgggtttgggggacaacaggcaggcaggggcagcaagatggtgttgcagacccaggtcttcatttctctgttgctctggatctctggtgccgtacggggacatcgtgatcgacccagtctccagacctccctgcctgtgtctcgtgggcgaggacggccaccatacaactcgacaagtccagccaggtagtttgtttttacttcgagcctaccgaactaaagtaaacgtaacttacttagtcgttacggtaaccagacaacgaaaccaggaccacgcctacctagctagctctagtttcgnggctacgtaccgtaccgggacgtcccgggtcctgaccgtattcgaggtcgcgacgggtcggtcgtggactagtacttccactctacaccatcagcacgctgacgagtcganaggctcggacgtcgtttagtttactacgtcgtacgactcttaacgtttacttaaccgtaccgttaaccctnttacccacgttacccggttcccggtacccggtaacgggtaaccgtaagggtaacgtaactaaacgtaccgaaacggttacttccgggacgttcccgcggtaacc

SEQ ID NO: 59027 - DNA, 715 bp, Homo sapiens
  misc_feature: GYAE6OF01EIQ92.10.53.E09.1.454.CMB.1.raw
  modified_base (282)..(282): a, c, t, g, unknown or other
  misc_feature (282)..(282): n is a, c, g, or t
  modified_base (379)..(379): a, c, t, g, unknown or other
  misc_feature (379)..(379): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagccgtgggaggtccctcagactctcctgtttagcctctggattcaccttcagttagttatcctttgccacgtcgggtccgtcgaggctccgaggccgaaggggctgggaggtgggtggctagttatctctagtttgatgganacaaataaatactacagagacgtccggttcgggcctattccacctactacctaccaaaagtactaagtttagaaacgaacgaccgtcttgtttacgngaactaaagtacgaaacacgacctaggacgacgacgtacggaacggtacgacggtcgttaggttacgttactttacgtttggttttccggttttggttccgttaggtaccggttacggggttaaccggggtaaacttaccgttacgacggtaccgtacgggtcggggaccgtacgggccctacccggtcgtacccgtaccgttacctccgtacaccgtacccgtacccgacggaaccggccctacgtcccggttccctccccgtacggcccctaccctccaccgaaccgtaccgtaccgtacccggttacggaccggggccacggcggtccccggg

SEQ ID NO: 59028 - DNA, 811 bp, Homo sapiens
  misc_feature: GYAE6OF01CU703.10.53.E09.1.454.CMB.1.raw
  modified_base (157)..(157): a, c, t, g, unknown or other
  misc_feature (157)..(157): n is a, c, g, or t
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
  modified_base (420)..(420): a, c, t, g, unknown or other
  misc_feature (420)..(420): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagccgtgggacgtccctnagactctcctgtttacgccctntggacttccaccttnagttagtttacttccctttgacctacgtcggggtccctcgacggtcctccgagggaccgaagggggtctggggtaggtggggtggacctaaggtttcncgtctagtttgagtaggaagaacaaataaatactaacgagacgtaccgttccggtcgggaccgtattaccacctatacctaaccaaacgtaactaagtttacgaaacgaaactcgtacttcgtttacncgaactaaactacgaacgacgtccgtagacgtagacgtaaggaacggaccgtacggtacgttgttacgttattttacggtttcggttttcggtttggtttcgttaggtaccggttaccggggttaacggggttaacttaccgttcgacgtaccgtaccggtccggggaccgtacgggaccccgtacccgtccggtacccgtacccggtcccttacccgtaccgccgtacccctacccgaacccggtacggtacccccgtacgttcccccgggttccccttccccggtaccggtacccctacccccgttacccgtaaacccgaaccggtaccgtaccccgtaccgggttacccgggacgggggaccctaaccgggtccccgggtccccgggg

SEQ ID NO: 59029 - DNA, 709 bp, Homo sapiens
  misc_feature: GYAE6OF01DVKK8.10.53.E09.1.454.CMB.1.raw
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagacctccctgcctgtgtctcgtgggcgaggcgggccaccatcaactgcaagtccagccagagttgttttatcagcctacgaacaataaagaacctacttagcttaggtaccagacaacgaaaaccnggacacgccctacctaagctgctctattttacgngggctacgtccgtaaccccggggtatccccggggtaccctggaaccgtagttacgacggtggacgacgggtccgggtcgtgggactagtacttttaccgaaccttccgtaccaaccctagtaccgacggaccacggtccctagggccaacggggccttaagggaaacgtacggttcgggacccgggttactttaacgggttttaattaaccggtcgttaccgaacggtaccttaaccgtttaatttaaaccgttaacccggttacccccctatttacccgaacgttacccggtttaccgggacccccgttaggggaaaccctaaaggggttacggaacgtacgtaaaccgtaaaccgtaattcgggtacggtcgtccggaacc

SEQ ID NO: 59030 - DNA, 926 bp, Homo sapiens
  misc_feature: GYAE6OF01EC5CA.10.53.E09.1.454.CMB.1.raw
  modified_base (282)..(282): a, c, t, g, unknown or other
  misc_feature (282)..(282): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtggggggaggcgtggtccagccgtggggacggtccctcagacctctcctgtttacgcctctggacttcaccttcagtagttactccttgccacgtgggtccgtcaggctccgaggcgaaggggctgggagtgggtggcagttatctctatttgatggaanaactaaataaatactaacagaacgtaccgtccggttcggggaccgtattaccaaccgtaacttaccgtaaccgaaaaggtaacctaaagttttaacggaaaagtaaaaccgtaccggttaccgtttacgttttccgtaacggtaactaaaaacgttacggaaaaccgtaaccgtcccgttaagggaaccggtaacggtaaccggttagggaaaccggggtaaccgtaaccgggtcgtttaacggtttagttttaaacgttttaccggttttacgggtttttaccgggtttttacgggtttaccgttacgggttaacccggtttaccgggggtaaaccggggggttaaaccctttaacccggtttccgaacgggtacccgtaaccggggtaccgggggtacccgaaccggggttacccgtacccccggttacgttacccggtaccccgttcccgttacccgttaccgtacccgtacccctacccgaaacccgggtaacccggtccccgtaaaccggttccccggttaccccgttcccccccgtgggtaccccccttaccccgttaccccgtaacccgaaacccgtcggtaaccccgtcccggttaccggggaccggggtacccaacggtcccgggtcccccgggg

SEQ ID NO: 59031 - DNA, 738 bp, Homo sapiens
  misc_feature: GYAE6OF01EPE90.10.53.E09.1.454.CMB.1.raw
  modified_base (155)..(155): a, c, t, g, unknown or other
  misc_feature (155)..(155): n is a, c, g, or t
  modified_base (388)..(388): a, c, t, g, unknown or other
  misc_feature (388)..(388): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggagcgtggtccagcctgggaggtccctnagactctcctgtttacgcctctggattcaccttcagttagtttacttcctttgcctacgtggggttcccgtcgacggcctccgagggccgaaagggggtctgggaggtggggtgctagttactctctatttgattggaagacaaataaatactacagacgactccggttacggggcctattccgaccattcctaccaaaagtactaatttgaaacgaacacgtcttagtttcngaccaaagtagaaacagcctggacgagcgtagaacggacacggtctagtgttaatttcgtacgtttcggtttgttcgtcgtacgttcggtacggggtaacttaccgttaccgacgtaccgtacggtcggggacccgacgggtccctaccccgttcgggtacccgacccgttcctcccgtaccgtaccgtcccttacccgaacccggaaccggtacccgtaccgttcccggttacccccgttccccccggttaccggtcccctaaccccgttaccccgaacccgtaaaccgaccggtacccctaccccgttccggtacccgggggacctaccccggccgggtacccccggg

SEQ ID NO: 59032 - DNA, 744 bp, Homo sapiens
  misc_feature: GYAE6OF01BDJJY.10.53.E09.1.454.CMB.1.raw
  modified_base (383)..(383): a, c, t, g, unknown or other
  misc_feature (383)..(383): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatcgacccagtctccagacctccctgcctgtgtctcgtgggcgaggacggccacatacaatgacaagtccagcagtagtgtttaatcagctaccgaactaaataacgtaactacgttacgcttaggaaccacgacaacggaaaccaggaaccacgtcctaccgtaagctgtactactacgttacgtggactacgtccggtaaccggtacgtccgggtacctacggaccgtntcgagtcggcacgggtcggtacgtaggacgtacgtactttaccacgttacctacgacctacgtacgacgacctacgcccttggaccgtaacgggtaccgtaagggtaacggtacgtacgggtaccgggtactttaaggttttaccttaaccggtcgtaaccgttaaccggtacctaaacgttttaacttaaacccgttaacccggttaacccttaacgtttaccgtaaaccgtttaccgggtaccccggttacccgggtaacgggtaaaacccggttaaacgggtacggtaaaccgtaaacccggttaaacggtaaaacccttacgggttaccgggttaccggtaccgtcccgtaaacccg

SEQ ID NO: 59033 - DNA, 587 bp, Homo sapiens
  misc_feature: GYAE6OF01CAFNO.10.53.E09.1.454.CMB.1.raw
  modified_base (321)..(321): a, c, t, g, unknown or other
  misc_feature (321)..(321): n is a, c, g, or t
  modified_base (391)..(391): a, c, t, g, unknown or other
  misc_feature (391)..(391): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagcgggccacatcaactgcaagtccagccagagttgttttatcagctaccgacaataagaactacttagcttgtaccagcaagaaaccaggacacgcctacctaagctagcctactattttacgngggactactcccgtaacccgggacgtcccggggtccctagacccgtattcgaggtcggctaggcgggtcnggacagtacttcactctaccacatcagcacgcngcagcagagntcgcgtctagtttactacgtgtacagacctacgttaattactaccgtacccctattaccaacgtcgttacccgggacccgtaacgggtaaacccgaaaggttacgggaacgttaaccgtaaccgtaaaaccggtacggttcgtacgggtaccc

SEQ ID NO: 59034 - DNA, 762 bp, Homo sapiens
  misc_feature: GYAE6OF01DIII3.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtcgccgtacggggacatcgtgatcgacccagtctccagtacctccctgcctgtcgtctcgtgggcgaggacgggcccaccatacaactgccaacgtccacgccagtagttgttttattcgacgctaccgaacaagtaaacgtaaccttacgttaacgtcgtttacggtaaccacgacgaaacgaaaccgacggaccacgtacctacctaacggctacgctcgttaacgtttacggtacggcctaacgtacccggtaaccccgggtaacgtccccggggttacctacgtaccgtacgttccgaacggttcggacgtacgggtccggggttacggtacgggtaacaggttacttttcctaaccgtccttaaccaaccgtactacccgagtaccgaaccgttccgacgaccgaggtaccgtaggtaaacgtacggtcggtaccggtaacgtttaacgtttttaacttaccgtcgttacgtaaccgtaacctaacgtttaactttaaccgtaacccttaacccgttacttaccgtacttacccggttccggacccgtacgggaaccgtaaaggtaccggaaagttaaccctaaacggtaaacccgttaacgtggtacccgtcgtcgtaaccccg

SEQ ID NO: 59035 - DNA, 986 bp, Homo sapiens
  misc_feature: GYAE6OF01BMOB5.10.53.E09.1.454.CMB.1.raw
tcagcatagtagtgcacgaccggtgctcgatttagagagagtgtgttgggtttgggggctctgggagacgagcccagcactggaagtcgccggtgtttccattcggtgatcatcactgaacacagagactcaccatggtagtttggctgagtcgttgggttttccctcgttgtctttacgttttaaggaggtgtccgagttgtcgaggtgctaggtcgtgggtggagttcggtagggggaggtcggttgggtcccgaggtccggttagggggtaccgttccccgtacgacggtaccttccgttccgttagttttaccgccgttcgttaggtacttccgtacctttacgtaagtttacgttttacttccgttttgaccgttaccggttcggggttacccttcggaacggttcccgtacccggaacggggaccggaacgggggtcgttagggggtaacgggttgggggttacggacgtttacggtttactcccgttagttagttttaggaacggttaggaaacgtaaacgttaaaagttaaaacgtacgtaaacgaacggtaccgttacccggtttacccggggtaccggggtaacccgttaaccgttacccgtaaccgtaaccgtaaccgttaaacccgtaaaacgttaaacgttaaacggtttaacgaaaaccggttaaaccgtaacccggtttaaccgtttacgttttaaccgttaacgtaaaccgttaaaacgttaacggtaaaccgtaacgtaacccggttaggaaccggtaacggtacggtaacgggtaaaccgggtaccggtaaccggttcggttaacggtttacggttttaaccggttttaaccggttttcgggttttttaccggtttaccgggttttaccggttaccgggtttaacccgggttaccgggggtttaaacccgggtttaaaccgtttaaccccggttacggtaaacccggtcccgggttaaaccccggggg

SEQ ID NO: 59036 - DNA, 665 bp, Homo sapiens
  misc_feature: GYAE6OF01EC8LQ.10.53.E09.1.454.CMB.1.raw
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtcctccagacctccctgcctgtgtctcgtagggcgagacgggccaccatcaactgacaagtccagccagagttgtttatcagctaccgaacaaactaagaaccttacgttaagtcgttacggtaaccagacaaacgaaaaccagggaacacgtaccgtacctaacgctagtactacgtaatttacgngggactacgtaccgtaacccgggaacgttcccggggtacctcgaaccgtntacaggtcggcgaggtcgggtacgcgggaacagtacttcactcctacacatcgacgcaacgcctagcgtcggactagaagtgtcgcggtactagtttactacgtgttacaagtcctaaattacttaactaccgtaacccttacttaccaaccgtttaccggttacccggtaccccgggttaacggtaaaacccggtaaacgggttaacgggaaacgtaaactaaacccggtaaaaccggttaacgttacgggtcggtaaccg

SEQ ID NO: 59037 - DNA, 706 bp, Homo sapiens
  misc_feature: GYAE6OF01B51KX.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctcgtggtgccgtacgggacatcgtgatcgacccagtctccagtacctccctgcctgtcgtctcgtgggcgaggacggccacatacaactgacaagtccagccagtagttgttttatcacgcctaccgaactaaataaacgtaacttaacgttagtcgtttacggtaccagacgaaacggaaaaccgaggaccacggtaccccttaccgtaaacggtcctacgtccttactaacgttttaccggtcgggacctaacgttaccccggtaaccccgggtaacggtccccggggtccctaggtaccgtattcgaggtcggacgacgggtccggttcgtacgggaacgtagttactttaccaccttcctaccgaacctatcgacgaccgacggtcctcggacgtacggctaaggaacgtcggtcgaccggtacttttaagtttaacttacgtcgtaccgaacgtactaactttaattacccgtaacccttacccgtatccgtaacttccggtacccggtacccgtaacgggtaacaaagggttcgaaacgtaactaacgaaacgtacctggccgtcacggtacc

SEQ ID NO: 59038 - DNA, 975 bp, Homo sapiens
  misc_feature: GYAE6OF01B74J6.10.53.E09.1.454.CMB.1.raw
  modified_base (183)..(183): a, c, t, g, unknown or other
  misc_feature (183)..(183): n is a, c, g, or t
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagagactcaccatggagtttgggctgagtcttgggttttcctcgttgcttcttttaaggnggtgtccagtgtcaggtncagctggtggagtcgtgggggagcgtggtccagccgtgggacgtccctnacgactctcctgtttacgcctntggattccaccttcagttagttactcctttgcctacgttcggggtcctcgacggccttcccgagggtaccgaaggggtcctgggtaggtggggtcggctagttactctcgttagtttgacgtaggaacgtaactaaaagttaaacgttaccgtaacgtaacgggtaaccgtacccggtttaccccgggggtttaccggggggtaacccgttaaccgtttacccgtaacccgttaacgttaccccgttaaacccgtaaaaacggttaaccttaaaggttttaaccggaaaacggttaacccgttaaccggttacccgttttacggttttacccgtaacggtaaaccgttaaaacggttaaccggaaacccgttaaacgggttaccccggttaaagggtaacggggtaaccggttacccggggttaaacggggtaaacccgggtaacccggtaacccgggggtttaccgtttaacgggggttttacccggtttttaaaacgggttttttaaccccggggtttttaacgggtttttttaccccgggggttttttaaacggggtttttttcccccggtttaacgggggtttaacccccggggttttacccggggggtttaaaccccgggggggttaaaacccctttttaaccccggggttttaacccgggtaaaccggggttaccccggtttaaacccccggggggg

SEQ ID NO: 59039 - DNA, 635 bp, Homo sapiens
  misc_feature: GYAE6OF01A8HFB.10.53.E09.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtgtctcgtgggcgaggacggccaccatcaactgcaagtccagccagngttgttttatcagctccgaanaataagaacttacttagtcttggtaccagcaacgaaaccaggacacgtccctctaagctgctactagttacgtgggactactaccgtacccgggacgttcccggggtccctaggaccgtagttcgaggtcggcgacggccggggtcgtagggactaggtactttacacgtcctaccaacctataccagctacgcctagacgaggtctagacgtagtggccgaagttagtttaacttaccgtcgtacacggtactacttaaacttacgttaacccgtaaccctattacccgtaactacggttacccgggtacccgtaccggggtaaaacgaacgggtacggaaggtaactaaacccggaaaacgtacggtcggtcggtaccg

SEQ ID NO: 59040 - DNA, 740 bp, Homo sapiens
  misc_feature: GYAE6OF01ADLR7.10.53.E09.1.454.CMB.1.raw
  modified_base (413)..(413): a, c, t, g, unknown or other
  misc_feature (413)..(413): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctcgtggtcgccgtacggggacatcggtgatcgacccagtcctccagacctcccgtgccttggtcgtcctcgtggggacgacggacggcccacgactacgaacgtgactaacgcacgcctaagtagttagtttactcgacgtcctaccgaataaacgtaacgtaaccttacgttagtcgttacggtaaccagtaccaaacgaaccgaggaacctacgccctacgtaacgtctacgctactacgtttcgcggtacacgtaccggaccggtacgtcccggtacncgtaccgtatcgacggtacggcgtacggtcgggtacgtacggactagttacgttacaccgtctaccgtaacctcgtacgacggacctacggtccgtaggaccgtacgggacgtaaggacgtacgtacggtacgttacgttaacgtttaccgttacgtacggtactaccgtaccttaaacgtttacgtaacccgttaacctacccccttagttaaccccgtaacccggttaccgggttcccggtaacccggttaacggtaaacccgggtaaagttaacccgggtaataacccgtaaacggtaaaccgttcgggttagccgtaacccgg

SEQ ID NO: 59041 - DNA, 565 bp, Homo sapiens
  misc_feature: GYAE6OF01EKFUO.10.53.E09.1.454.CMB.1.raw
  modified_base (391)..(391): a, c, t, g, unknown or other
  misc_feature (391)..(391): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagcttgggttttcctcgttgcttcttttaaggaggttgtccagtgtcaggtgcagcgtgggtggagtcggtggggggaggcggtggtccagccgtggggcggtcccctgagaccttctccgttgtttacgtcctctggtacttctaccttctagtagttattcctttgctacgtcgggtccgtcgaggctccgaggcgaagggtcgtggaggtgggtggcaggttatctcatttgatgganacaataaatactaacagagactccgttcggggcctatcacatcctccaaagacaattgaaagacacgctgttctagcaagtgaacagcctgagagcgtagagacacggctgtgtattcgttgttcgtttggttcgtgtacgttcggtacggggtaactaccgttcagcgtacgg

SEQ ID NO: 59042 - DNA, 733 bp, Homo sapiens
  misc_feature: GYAE6OF01A1GB4.10.53.E09.1.454.CMB.1.raw
  modified_base (378)..(378): a, c, t, g, unknown or other
  misc_feature (378)..(378): n is a, c, g, or t
  modified_base (721)..(721): a, c, t, g, unknown or other
  misc_feature (721)..(721): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctcgtggtgccgtacggggacatcggtgatcgacccagtcctccgacgtacctcccgtgccttgtcgtcctcgtggggcgaggcggaccaccatcaacgtgacaacgtccacgcagtagtttgtttactcacgtcctacgaactaaagtaacgtaacttacgttacgtacgttacggaccaaggaccaacgaaaaccgaggaaccacggtaccctacgtaagcttccgtacttacttagtttaccgngggacctacggttaccggtaacccgggtaaccggtccccggggtacctacggtaacccgttacgttacggcggtcggacgtacgggtcgggtacgcggtaactgttacttccgactcctaccactgacaacgcgaccgtcgagccgtaggtacgtaggaacggtcgtacggtacggttaactttacggtttaacctagtccggtaactacgttaaccgtaacttaagttacctaacccgttaccttacgttaccgaaccgtttccggtaaccccgggttaccgaaacggggtaaacgtaacgggtaggtaacctaaacgtaacccggtaaggtttaacccggnggttcggacccg

SEQ ID NO: 59043 - DNA, 848 bp, Homo sapiens
  misc_feature: GYAE6OF01A3TJY.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttctatttctctgttgctctggatctctggtgccgtacggggacatcgtgatcgacccagtctccagacctccctgcctgtcgtctcgtgggcgaggacggccaccatacaacgtcgacaacgtccacgaccagtaggtttagttttactacgacgtcctaccgaactaaaagtaaacgtaaaccttaacgttaacgtccgtttacggtaaccagaccaaacgaaaccgaggaaccacgtcctaccgtaacgctcgtactactattacgcgggtactacgtaccgtaacccgggtaacgtcccgggttacccacggtaccgtactttcgacggttcggaccggtacgggtaccggggttcgtaacggggtaacgtaacggttaactttaccggtaaccctttaccgtaccccggtaaacccttacgtacccgttaaaccggaccctaaccggggtccccgtttaacgggaacccggtaccggggtacttaaccggggtaaaacgttacggtacgggtaccccggtaagttttaacggttttaactttaccggttacggtaactacggttaacctaaacctttaagtttaaaccctaccggtttaaccccttattaccccgtaaacgttacccgggtttaccccgggtaccccggttaaacgggtaaaacccgtaaagggttcgtaaacggtaaaccgtaaaccgtaaaaacccggtacggtttcgggtacggttaacccg

SEQ ID NO: 59044 - DNA, 718 bp, Homo sapiens
  misc_feature: GYAE6OF01E3QE7.10.53.E09.1.454.CMB.1.raw
  modified_base (522)..(522): a, c, t, g, unknown or other
  misc_feature (522)..(522): n is a, c, g, or t
tcagcatagtagtgcacgaccggtgctcgatttagagagagtgtgttgggtttgggctgagcgtggtttcctcgtgctcttttaagaggtgtccagtgtcaggtgcagctggtggagtcgtgggggaggcgtggtccagcctgggaggtccctcagactctcctgtttagcctctggattcaccttcagtagttatcctttgcacgtcgggtcctcaggcctccgaggcgaagggggctgggaggtggggtcggctaggttatccgtctagttttgagtcggaagaactaaataaataactaacaggacgaccgtcccggttcggggcctacttccaaccgtactaccgtaaccaaaagactaaagtttagaaaacgtaacaccgtcttagttttacacgaactaaagtacgaaacacgtacctaggagacgctaggaacggaccgacgtcgttagtattaacttacgtttacgtttcggtttacgttcgtacgtcgtacgggtacgggtaactccgttacnggtacctggaccgggccgacggtaccctccgtacggtcccgtaccgttcctcccgacggtacctacccctacccgaaccggtaccggcccttacggtcccggttccctaccccggtccgtccccgtaaccccgtccctaccggacgtaacccgcccgttaccggttccggacgggtccgaacccgccgggtcccgg

SEQ ID NO: 59045 - DNA, 754 bp, Homo sapiens
  misc_feature: GYAE6OF01AI5KP.10.53.E09.1.454.CMB.1.raw
  modified_base (247)..(247): a, c, t, g, unknown or other
  misc_feature (247)..(247): n is a, c, g, or t
  modified_base (375)..(375): a, c, t, g, unknown or other
  misc_feature (375)..(375): n is a, c, g, or t
tcagcatagtagtgcacgaccggtgctcgatttagagagagtgtgttgggtttggggacaacaggcaggcaggggcagcaagatggtgttgcagacccaggtcttcatttctcttgttgctctggatctctggtcgccgtacggggacatcgtgatcgaccctagtcctccacgacctccctgcctgtgtctcgtgggcgaggacggccaccatccaactcgacgtaacgtccagccagtacgtttnttttatcgacgcctaccgaactaaagtaaagaaccttacgttacgtacttacggtaccagacgaaacgtaaaccgacggaaccaccggtaccttaccgtaacgtcctacgtcctactacgtttacggnggtacctacgtacccggtaaccgggtacggtcccgggttccctacgtaccgtaacgttcgagggtcgcggtaacggtccgggttcggtacgggtaacgacgttactttccgaaccgtcctacgtaacctacgtcacgtcgaaccgtccgtacgacgtacggacgtaacggaagtacggtacgtaccggtacgtttacgtttagttaaccgtcgtaccgtaaccgtcgttaacgttaactttaccgtaaccttacccgttaacgttaaccgtaccgttaacccggttcccgggtaaccgttaccgggtaaacgtaacggtacgggtaaacctacgtaaccgtaaacggtacgttaaggtcggtaaactccggtaaacccg

SEQ ID NO: 59046 - DNA, 807 bp, Homo sapiens
  misc_feature: GYAE6OF01B9W91.10.53.E09.1.454.CMB.1.raw
  modified_base (348)..(348): a, c, t, g, unknown or other
  misc_feature (348)..(348): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtcctccagacctccctgcctgtgtctcgtgggcgaggacggccaaccatacaactgacaagtccagccgagtagttgttttatcacgcctaccgaacaaataacgaacttacgttacgtcgttacggtaccagacaaacgaaaccgaggacacgtcctacgtaagctgctactatttacgnggactacgtacccgtaacccgggtacgttccccgggtacctacggtaacccgtagttacggacggtcggtaccgtacgggtccggggttacgtaaggggtaactacggttactttaccgaaccttcctacctaaccgtaacgtaccgaaggtaccgtaccggtacccgttaggacccgacggttacgtaacgaaacggtaacgttcggaccggttaacgtttaacgtttttacgttaaccgtacggtaccgtacggttaacgtaaacggtttaacgttaaacgaccggtaacccgggttcccggggaccccccggtaccggggttaaacccccgggttccgggaaaacccggggtaaaccggggggttaccggtaaaccgggggttaaaggttaaaaccccgtttaaaccgggtaaaaacccggttacgggtttacgggtcccgggtaccgttaacccg

SEQ ID NO: 59047 - DNA, 842 bp, Homo sapiens
  misc_feature: GYAE6OF01BCZJM.10.53.E09.1.454.CMB.1.raw
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagcgttgggtttttccctcgttgcttacgttttaagaggtgtccagtgtcgagggtgcaggtcgtgggtggagtcgtggggggacggcggttggtcccaggtcccgtggggggaccggttccccctacgaggaccttccgttccgttggttttacgcccttcgtggtaactttccaacctttcgaagtttacgttacttcccgtttgcctacgttcggggtccgtcgaggtcctaccggagggtccggaacgggggtctggggacgggttggggtcggcttaaggtttacttctacgttagtttacggagttagggaagacgtaaaattaaacgtaacttacgaaaggtacggtacccgttccccggggttccgggggtaacccgttacgttaccgaaccctacgttacccgtaacccgtaaaacgtacgttaaacgtttaaggaaaccggtaaccctaaccggttccgtttacggttttacctaggtaacctaaaaggtccgaaaacgtcgtacctaggacgtacggtacgtacggacggtaaccgcggtcgtttaggtacgtttacgtttaccggtttcgggttttacgttttgggtttccccgttagggttaccgggtttaacccgggggtttaacggggttaacctttaaccccggtttaccggtcgggtccggttaaacccgggggg

SEQ ID NO: 59048 - DNA, 657 bp, Homo sapiens
  misc_feature: GYAE6OF01BEARP.10.53.E09.1.454.CMB.1.raw
  modified_base (155)..(155): a, c, t, g, unknown or other
  misc_feature (155)..(155): n is a, c, g, or t
  modified_base (629)..(629): a, c, t, g, unknown or other
  misc_feature (629)..(629): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctnagactctcctgtttagcctctggattcaccttcagtagttatcctttgcactgggtcctcaggctccaggcgaaggggctggagtggggtggctagttatctctatttgatggagaacaataaatactacagagacgtccggttcggggccattcacatcctaccaaagactaattagaacgaacacgtctgtttcagacaaatacgaaacagtccgtagagagacgtaggacggacacggtctgtacgtttacttacgttggtttcggttttaggtttccgtaggtaccgttcgggttacgggggtaacttacccgttacgacggtaccgacggtcggggaccgacgggtaccctacccggttcggtaccgtcccggttacctcccgtacgtaccgtcccctaccgacccgtacgggcccctacgttccgttccccttccccgtcgccctacccctcccgtaccgaacggccncccgacccgtcgacgacgccgacgccgg

SEQ ID NO: 59049 - DNA, 785 bp, Homo sapiens
  misc_feature: GYAE6OF01BKDF3.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacggggacatcgtgatgacccagtctccagactccctgcctgtcgtctcgtgggcgagacgggccacatcaactgcaacgtccagccagtagttagtttttatcagcctaccgaacaaataacgaactacttagcgttcggacagcaacgaaccacggacacgccctactaagctgcttactactttacgtcgggactacgtccggtaacccgggtaaccgtcccggggttaccctacgggtaacccgttactttacggaagggtccgggacgtccggggtaccggggtttaccggtacggggtaaccgtaaggtttacccgttttacccgtaacccgttacccgtacccctaaccgttaccgttacccgtaacgaccgtaaccggcccgttacgaacccggtacgggtaaccgttaaggaaacgtacggttacgggaccgggtacgttttaacggttttaacgtttaaccgttcggttaacccgtaacgtaaccgtttaactttaacctttacgttaaccccgttaacctacctttaccgaccttaccggttacccgggtacccggtaacgggtaaaccgttaaagggtacggtaaacgtaaccgtaaccggtaaaacgtacggttacggtacggtacccg

SEQ ID NO: 59050 - DNA, 711 bp, Homo sapiens
  misc_feature: GYAE6OF01C0EPQ.10.53.E09.1.454.CMB.1.raw
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacggggacatcgtgatgacccagtctccagactccctgcctgtcgtcctcgtgggccgaggacgggcccaccgataccaactgaccaagtccagccagtgttgtttatcagctaccgaanaataagaacttacttagcgttggaccagtcaacgaaaccaggaccacgacctacctaagcctagctactaagttttacgngggtacacgttccggtaacccgggtacgttcccggggtccctacggacccgtacttacgacggttcggcgtacggccggggtacgtagggactacgtactttacgaaccttcctaccgaacctataccgacgtcctacggtcccgttgaccgtaggtaccgtaggaacgtagttccggacggttacgttaagttttaacgttacgtacgtcgtacgtccttaacttaacgttaccgttaaacccgttaccccttaagttaccctaacggtacccgtttacccggggtacccgtaaacgggtaaaccggtaaacgggttcggaaacgtaccgttaacccgaaaagggtaccttggtacggttaacccgg

SEQ ID NO: 59051 - DNA, 845 bp, Homo sapiens
  misc_feature: GYAE6OF01AENN9.10.53.E09.1.454.CMB.1.raw
tcagcatagtagtgcacgaccggtgctcgatttagagagagtgtgttgggtttgggggagctacaacaggcaggcaggggcagcaagatggtgttgcacgacccaggtcttcattttctctgttgctctggatctcgtggtgccgtacggggacatcgtgatcgacccagtcctccacgacctccctgcctgtcgtctcgtgggacgaggacgggcccacataccaacgtcgacaacgtccacgccgagtagtttgttttatcacgcctaccgaactaaagtaacgtaaccttacgttacgtacgttacggtaaccagacgaaacgaaaacccgaggaaccgacgtaccctaaccgtaacgtcctacgccttacgtactttacggcggactaccgtaccggtaacccgggtacggtcccgggtaccgtacgaccgtacgtcgacggtcggacggtacgggacgggtacgtaacgggactacggttacctttaccgaccgttaccgtaccctaaccgtaactacccggacgtaaccgtaccggtacccgtacggaaccggtaacggtaccgtaaaggaacggtaccggtacggtaaccgggttaccgttttaacggttttaaccgtttaccggtaacgtaccgtaaacgttacccgttaaacgtttaacgtttaacccgtttaaacccgttaaaccccgttacgtttaaacccgtaacgttaacccggggtttccccgggaacccgggttaaaccgggtaaaccggttaaaacggggttaccggaaaacgttaaacccgtaaaccggtaaaaaccgggttccggtttacgggtacggttaaccccg

SEQ ID NO: 59052 - DNA, 669 bp, Homo sapiens
  misc_feature: GYAE6OF01ESTVJ.10.53.E09.1.454.CMB.1.raw
  modified_base (141)..(141): a, c, t, g, unknown or other
  misc_feature (141)..(141): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (333)..(333): a, c, t, g, unknown or other
  misc_feature (333)..(333): n is a, c, g, or t
tcagcatagtagtgcacgaccggtgctcgatttagagagagtgtgttgggttttcctcgttgctcttttaagaggtgtccagtgtcaggtgcagctggtggagtcgtggggggaggcgtggtccagcctgggaggtccctnagactctcctgtttagcctctggattcaccttcagtagttatcctttgcactgggtcctcaggctccaggcaaggggctggagtgggtgctagttatctcatttgatgganacaataaatactanagagactccggttcgggccattcaccatcaccaaaagactaatttgaaacgaacacgtcttgtttcngacaaatgaacacgcctgagagcgtggaggaccgacggtctggtagttatttacgttggttttcggtttggttctggtaccggttacgggtacggggtaaacttccgttacgacgtcgtacggtcggggaccgacgggcctacccggtcggtacctaccgtcctccgtcacgtcccaccgaaccggacgggtcccctacgttcccggttccccttaccccggtccgtacccctaccccgttcccgtaccgaaacgccgtcccgtaaccggtccgggtcgggggacctaccggaccggtcccgggacccgttcgggccgtcggtccggttaaccggg

SEQ ID NO: 59053 - DNA, 768 bp, Homo sapiens
  misc_feature: GYAE6OF01AG85S.10.53.E09.1.454.CMB.1.raw
  modified_base (444)..(444): a, c, t, g, unknown or other
  misc_feature (444)..(444): n is a, c, g, or t
  modified_base (475)..(475): a, c, t, g, unknown or other
  misc_feature (475)..(475): n is a, c, g, or t
tcagcatagtagtgcacgaccggtgctcgatttagagagagtgtgttgggtttgggggagctacaacaggcaggcaggggcagcaagatggtgttgcacgacccaggtcttctatttctctgttgctcgtggatctcgtggtcgaccgtacggggactatcggtagtacgtcgaccctagtcctaccgacgtaccttcccgtcggtccttggttcgtccttcggtcggggaccggaacgggaccgggaccctaaccgtactaccgtaaacgttcggaaccgtaaaccggtcccgaacgtaccgtaagggtttacgtttttacgtttttaactaccgtcggtccctaacccggaattaaacgtaaccgtacttagttacgtcgttacgtacacgataaccgaaacgacggtacacgaccctagtacgctctactactacgtacgngactcgtaccggaccggtacgtcccggtccncgtacgtatcgtagtcggcgtaggtcggacgtacgtactcggtacttaccaccgttacacgtactacgtgacccgtcgaccaccggtcgacggtacgttcaaaggtacgtcgtacggtacgttacgtttaacgtttacgtaccgttagaacccggtactaagtttaaccgtacgtttaacccaaccggttcctaacgtaaccgttaccggaccggtttacccgggtaaccgtacgggactaacgggttgtaaacccgtaattaacccgtaaagtcggtaccggtgggtacccc

SEQ ID NO: 59054 - DNA, 623 bp, Homo sapiens
  misc_feature: GYAE6OF01EUH2Z.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgccgtacgggggacatcgtgatcgacccagtctccagacctccctgcctgtgtctcgtgggcgagacgggcccaccatcaactgacaagtccagccagtagttgttttactcagctccgaacaaataagaacttacgttagtcttacggtaccagcaacggaaaccaggaacacgcctacctaacgctgctactagtttacgtggctactccgtaacccgggtacgtcccggggtccctacgacgtacttcgagtcggcgaggtccgggtcgtagggactagtactttcacttcctacacctacgtacgacgtcgacgtccctaggaccgtacggtacgtaggaaacgtagtcggaccggtagttaacgtttagttactcgtacgtaacgtactacttaacttaccgtaccgtaccctataccacttacgtccggtaccgtacgggaacaagggtgaacgaactacgaaacgtactggtctacg

SEQ ID NO: 59055 - DNA, 778 bp, Homo sapiens
  misc_feature: GYAE6OF01DOFFA.10.53.E09.1.454.CMB.1.raw
  modified_base (686)..(686): a, c, t, g, unknown or other
  misc_feature (686)..(686): n is a, c, g, or t
  modified_base (766)..(766): a, c, t, g, unknown or other
  misc_feature (766)..(766): n is a, c, g, or t
tcagcatagtagtgcacgaccggtgctcgatttagagagagtgtgttggggtttgggggagctacaacaggcaggcaggggcagcaagatggtgttgcagacccaggtcttctattttctctgttgctctggatctctggtcgccgtacgggacatcgtgatcgaccctagtcctccacgtcctcctgtcctgtcgtcctcgtgggcgaggacggaccaccataccactacgacacgtccacgccgtagtagtttcgttttactccgagtccctaaccgaacgtaaaataacgttaaaccttaacgttacgtccggtttacggtaccacgaaccgaaaacggaaaaccgacggaaccacgtaccctaccgtaacgcctcgtacttaccttaagttttaccgacggtacctacgttaccccggtaaccggggtaaccgtttcccgggtacccgtacggaacccgttagttccggaaggtcggacggtacgggtaccgggtcgtaggaccgttagttacctttaccaccgttacctaccgtaaccctacgtacgaaccgaccgtacggtcccgagtacgaccggtacgtaagaccgtaggtacccggacgggttaacctttaggttttaaccttaccgtacgtaccgtaagtaccttaacgttaattaaccgttaaccctaacccttntaacccgtacttacccggtcccggtaacccggtaacggaaacgttaacggagtaaaccggtaactaaacggaaaccggtntcggcgtaaccg

SEQ ID NO: 59056 - DNA, 949 bp, Homo sapiens
  misc_feature: GYAE6OF01AJ5I9.10.53.E09.1.454.CMB.1.raw
  modified_base (155)..(155): a, c, t, g, unknown or other
  misc_feature (155)..(155): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctnagactctcctgtttagcctctggattcaccttcagtgttatcctttgctactgggtccgtcaggctccgaggcgaaggggctagggagtggggtcggctaaggttatccgtctaagttttgagttaggagaaccgaaattaaatacgtaacagaacggtaaccgtcccgggttccggggacccgtacgtttaccgaacccctaacttccgtaaccgtaaaaacggaaccttaaaacgttttacggaaaacggaaaacccgtacggtaccttttacggttttaccgttaacggtaaccgtaaaaacgttacggaaaacccgtacggtaccccgttaggaacggtaacggtccgttaggaacgggtaacccggtaccgggttacgtttcggttaagtttaaccggttttaccgttttacgggttttccgggtttttacggggttttacctaccggggttaaccgtttcccgggggttaacccgggggtaacgtttaaccccgtttcggaaaccgggttcccgtaaccggggttaccggggcccggaaccggggtcccctaaccccggtttcgggtaccccgttaacccgttcccgtacccgttacccgaccggttcccccgtaacccgtaacccgggaaacccgggtcccccttaacgggttccccggttacccccgtttccccccggtcggtacccccgttacccccccttcccggtaaacccgtaacggtacccccgaccggtaccccgttccgggggacgggaccccgtaccggtcccggggtacccccgggg

SEQ ID NO: 59057 - DNA, 786 bp, Homo sapiens
  misc_feature: GYAE6OF01AY6PJ.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagaggccaccatcaactgcaagtccagccagagttgtttattcagctaccgaactaataaagtaactacttagcttaggtaccagacaagaaaccaggacacgtacctccgtaaagctgctacatttacgtgggctacgtaccgtacccgggtaacgtcccggggtccctaggacccgtagttcaaggttcgaccgtagggtccggggtcgtacgggggtaaacaggtaacttttaccgaacccttctaccctaacccgtaacttaccgaacggtccgtaacggtccccgttcggacccgtaagggtacctaaagggtaaacggtaacgttacggggaccggtaaccgttaaacgggttttttaaacccttaacggtttaccggttacctaaaccggttacccttaaaacctttaacgtttaaacgttaaccccgttaaacccccgttatttaacccgtaaccgttaacccgttttacccggggacccccgtttaaacggggtaaaacccgttaaaggggtaaccgggtaacgtaaacggttaaccgaaaaaccggttaaccgtttaggtcccgggttacgtacccgtaaacccg

SEQ ID NO: 59058 - DNA, 840 bp, Homo sapiens
  misc_feature: GYAE6OF01AWOXJ.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgttagcctctggtacttcaccttcagttagtttacttcctttggctacgtcgggtccgtcgacggtcctccgaggcgaaggggctgggaggtgggtggctagttactcgtactatttgagtaggaacgtaactaaataaactacgtaacaaggtacgtaccgttccgggttaccggggtaccgtacttaccgacctacgttacccgtaaacccgtaaacgtaaccgttaaacgtttacggaaaacgtaaccgtaaccgtcgtttacgtttacgtaggtaacctaaaacgttacggaacctaacggtcccgtaaggacggtacgacgtaacggaacggaccgtacggttcgtacggttagtttacgtttacgttcggttttcggtttacggttacgtacgtaccgggttacgggtacggggtaacttaccgtacgacggtacgtaccgggtacgggtacccgacgggtccccgtcgtaccgtccgtaccgtcctaccgtacgtacccgtaccgtacccgaaccggtaccgtaccccgtaccgttccccggtaccccttacccccggtaccgtacccccttacccccggtaccgtaaaccccggtaccgggtaccctaccccggttcccggtaacccggggttcgggaaccctaacccggtcccggggtaccccggg

SEQ ID NO: 59059 - DNA, 814 bp, Homo sapiens
  misc_feature: GYAE6OF01BMWH1.10.53.E09.1.454.CMB.1.raw
  modified_base (156)..(156): a, c, t, g, unknown or other
  misc_feature (156)..(156): n is a, c, g, or t
tcagcatagtagtgcacgaccggtgctcgatttagagagagtgtgttgggtttgggctgagctgggttttcctcgttgctctttaagaggtgtccagtgtcaggtgcagctggtggagtcgtgggggaggcgtggtccagccgtgggaggtccctnagactctcctgtttagcctctggattcaccttcagtagttatcctttgcacgtgggtccgtcacggcctccaggccgaaggggctagggagtggggtgactagttatcgtctatttgatggagactaaataatacacagacgtacctccgggtccgggcctattccgaccagtcctaaccaaaggtactaagtttagaaacgaccgtacgtcttcgttttacgagtaaccaaagttacgaaaccgacgccgttaggaacgacggtacgtaggaacgggtaaccgacgggttccttaggttacgttttaacgtttacggttttcggtttttccgggttttacgggtttaccgttacggggttaccggttacccggggggttaacggggttaaacctttcccgttaacgaccggtacggttacccgggtcgggggacccgtacgggtacccccgtaccgtccgggttacccgtacccggttacccttacccgtaccgtaccgtaccccctaaccgacccggacccgggtacccccgtacgtcccggtttacccccgttccccggtacccgtcccctaacccccgtccgtaaaccgaaccgtaccgttacccggccccggttacggggtacccgggcctaaacggcccgggtacccccggg

SEQ ID NO: 59060 - DNA, 838 bp, Homo sapiens
  misc_feature: GYAE6OF01CMQBH.10.53.E09.1.454.CMB.1.raw
  modified_base (175)..(175): a, c, t, g, unknown or other
  misc_feature (175)..(175): n is a, c, g, or t
  modified_base (695)..(695): a, c, t, g, unknown or other
  misc_feature (695)..(695): n is a, c, g, or t
  modified_base (729)..(729): a, c, t, g, unknown or other
  misc_feature (729)..(729): n is a, c, g, or t
tcagcatagtagtgcacgaccggtgctcgatttagagagagtgtgttgggttgggctgagctgggttttcctcgttgctcttttaagaggtgtccagtgtcaggtgcagctggtggagtcgtgggggaggcgtggtccagcctgggagtccctcagacctctcctgtttagcctntgattcaccttcagtagttacttcctttgcctacgtcgggtccctcgaggcctacccgagggccggaagggggcttgggggaggttgggggtcggctaaggttttactccgtctaagttttggaagttgggaagaacctaaaattaaaactaacctaaccgaggaacggtaccgttccgggttccgggggaccctacttaccgaacccgtacttacctaacccgtaaaaacggtaccttaaagttttacggaaaacgtaaaccctaaccggtctttcggttttactacgaactaaacgtacgtaaacgaacgtccgtacgacggacgtcgtacggaacggaccgtaccggtacgttagttacgttaactttacgtttcggttttacggtttcggttaccgttacgggtaccggtaccggggttacgggtaaccgttaacccgttcgaggtaccgacgggtccgggaccggtacgggaccctacccggttcgtacccgtacccggtacccttccgtacccncgacccgtacccgaacccggaccggttaaccccncggtttacccggtcccccttccccggtccgtccccctacccctacccgtacccgaacgaccgtacccgtccgttcccgggacggggcccaaccggtcccggtccccggg

SEQ ID NO: 59061 - DNA, 884 bp, Homo sapiens
  misc_feature: GYAE6OF01BBBV6.10.53.E09.1.454.CMB.1.raw
  modified_base (411)..(411): a, c, t, g, unknown or other
  misc_feature (411)..(411): n is a, c, g, or t
tcagcatagtagtgcacgaccggtgctcgatttagagagagtgtgttgggtttgagggagctacaacaggcaggcagggcagcaagatggtgttgcagacccaggtcttcatttctctgttgctctggatctctggtgccgtacggggacagtcgtgactcgacctagtcctaccagtacctcctgtcctggttcgtctcggtcgggacgaggacggacccaacctacgtacctaacgtcgaccgtaaccgtccgaacgaccgtaagttacggttttagtttttaacttccgacgtacccgttaaccggaaactaaaacgttaaaacgttaaaaccctttaacgtttaacggtccggttttaaccgggaacccgacggtaaccgaaaacggaaaacccggacggtaaaccnccggtaccccgttaacgtaaacgtcgttaacgtcctttaaccttacgttttaccggtacgggtacctaaccggttacccgggtaacccggggtaaccgttccccggggttaccctacggtaaccgttacgtttcggacgggttcggacgggtacgggtccgggtttacggaccgggtacgtaaccgtttacgttccgtacctacctaccgaacctacgtacgacgcccgtacgtccgttacgaccgtaaggtccgtaacggagtaccggttacgggtacccggttactttaacggttttaaccttacgggttacgtaacggacttaacccgttaacgtttaaccgttaaccgttaccccgttaaaccttcgacccttaaccggtttcgtacccccgggttaccggaacggggtaaacccttaaggggtacgtaaaccgttaacgaaacccgtaacgggtcgttcgggtaaccg

SEQ ID NO: 59062 - DNA, 728 bp, Homo sapiens
  misc_feature: GYAE6OF01D71FF.10.53.E09.1.454.CMB.1.raw
  modified_base (550)..(550): a, c, t, g, unknown or other
  misc_feature (550)..(550): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctcgtggtcgccgtacggggacatcgtgatcgacccagtctccagaccttccctgtccttggtcgtctcgtcgggcgaggaccgggccaccactcaactgactaacgccacgcctaggtagttttgttttactccgaggtacctacccggaaactaaagtaaacgtaaccttacgtttacgccgtttacggaaccaaggaccaaacggaaaccgacggaaccgaccgtacccgttaaccgtaacggccttacgtccttacttagtttacggcggactaccgtccggtaacccgggtaccggtcccgggtcctcgacgtacttgacggtcggtacgcgggtcggtagacggtaactctaacgtttcctaccttcgtaccacctactaccgacgtccgacggtcctacggacgtacggtanaacggtaacgtggtaccggtcggttaaccgtttaacgtttacttacggtacgacgtacgttacttaacgttacgttaacctaccttacccctaattcctacggttccgtacccgggtaccgaacgggtacgaacggtaggaaacccttaggaacctaaggttacggtggtacgtcccg

SEQ ID NO: 59063 - DNA, 637 bp, Homo sapiens
  misc_feature: GYAE6OF01A1VEV.10.53.E09.1.454.CMB.1.raw
  modified_base (179)..(179): a, c, t, g, unknown or other
  misc_feature (179)..(179): n is a, c, g, or t
  modified_base (239)..(239): a, c, t, g, unknown or other
  misc_feature (239)..(239): n is a, c, g, or t
  modified_base (241)..(241): a, c, t, g, unknown or other
  misc_feature (241)..(241): n is a, c, g, or t
  modified_base (626)..(626): a, c, t, g, unknown or other
  misc_feature (626)..(626): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctgggtgccgtacggggacagtgtgatcggacccagtcctcagacctcctncctgtcgtctcgtgggcaggcggccacatcaactgacaagtccagccagtgttattttancncgctacgataataacgaacttcgtagcgttggaaccagactaacgaacaggaccagtccctacaagtctacgtctactagttacgcggactacgtcccggtaaccggagttccccggcctagaccgtagttcgaggcggtacgagggtccggtacgtagggtactacgttacttccgactccgtactacacttacgacgtacacgtcgtacgcgtaggctacggaagtcgtacgtcgtacgtttattacgtagttcgacgtacacgttaaccttagtaacccgttacgtaccccttatacccgtacggttaccgtaccccgggttaccgggtaaacgtaccgtaagggtacgtacgtaaacgaaacgtaacgtaccgtaggtccncggtacgtacc

SEQ ID NO: 59064 - DNA, 793 bp, Homo sapiens
  misc_feature: GYAE6OF01CS638.10.53.E09.1.454.CMB.1.raw
  modified_base (520)..(520): a, c, t, g, unknown or other
  misc_feature (520)..(520): n is a, c, g, or t
tcagcatagtagtgcacgaccggtgctcgatttagagagagtgtgttgggttgggggagctacaacaggcaggcaggggcagcaagatggtgttgcagacccaggtcttcatttctctgttgctcgtggatctctggtcgccgtacggggacatcgtgatcgacccagtcctccagtacctccctgccttgtcgtctcgtgggcgaggacggccaccatacaacgtcgacaacgtccacgcgagtagttcgtttatacgacgtcctaccgaaataaacgtaaacgtaacttacgttacgacgttacggtaaccagaccgaaacgaaaccgaggaacctacgacccttacgtaacgccttacggccttacgttaacgtttacggacgggactaccgttaacccgggtaccgggtaacgttccccgggtacctagaccgtaagttcgaggtccggacgtacgggccgggttatacggggaacttacggtactttcaacctccaccaccgtactcacgcgacncgtcgacgtacggcgtaagaacgtcgtacgggaccgttaagtttacgtttaaccgtacggttacgtaaccggtactaacctttaaaccgtttaacgttaaccgttaaccccggttaacccttaaccgtttaccctaacccgggtttaccccggtttaacccgggtacccgggttaaacgggtaaaacccggttaaaacggggttacggaaaccgttaaaccggtttaaaaccccgaacgggttttaaaccggtcgggtttaccgggtaacccg

SEQ ID NO: 59065 - DNA, 829 bp, Homo sapiens
  misc_feature: GYAE6OF01E4RWI.10.53.E09.1.454.CMB.1.raw
tcagcatagtagtgcacgaccggtgctcgatttagagagagtgtgttgggtttgggctgagctgggttttcctcgttgctctttaagaggtgtccagtgtcaggtgcagctggtggagtcgtgggggaggcgtggtccagcctgggacggtccctcagactctcctgttagcctctggattcaccttcagtagttatccttgcactgggtccgtcaggctccgaggcgaaggggctgggagtgggtggctaggttatctctattttgagtggaagaactaaataaatactaacagacgtaccgtccggttcggggacctattccaccgtactacctaccaaaagtactaaactttagaaacgtaacacgtcttacgttctagaactaaatacgaaacacgtacccgtaggaacgtacgtacggtaggaacggaacccgaccgggtacgttggttaacggttacttttaccggtttagggttttaccggtttttacgggtttcgttacgggttaccggttacccggggtttaaccgggggtaaacctttacccggtttaccgacgggtaccggtaacccgggtacgggggtacccgtaacggggtcccctaaccccggttccgggttacccgtacccccggtttcccgtaccccgtaccgtacccggtacccccgtaccccgaacccgggtaacccggtccccgtaccggttccccgggttccccccttacccccggtccggtacccccttacccctacccgtaacccgaacgtacccggtcccgtacccggtacgggtaccggggcccaaccgggcccggtaccccggg

SEQ ID NO: 59066 - DNA, 885 bp, Homo sapiens
  misc_feature: GYAE6OF01DP0EK.10.53.E09.1.454.CMB.1.raw
  modified_base (184)..(184): a, c, t, g, unknown or other
  misc_feature (184)..(184): n is a, c, g, or t
  modified_base (713)..(713): a, c, t, g, unknown or other
  misc_feature (713)..(713): n is a, c, g, or t
tcagcatagtagtgcacgaccggtgctcgatttagagagagtgtggttgggtttgggggctctgggagacgagcccagcactggaagtcgccggtgtttccattcggtgatcatcactgaacacagagactcacagtggtagttggctgagtcgttgggttttcctcgttgcttacttttaagnggtgtccagtgtcaggtgcagtcgtgggtggaggtcggtggggggacggtcggttcggtccgaggtcccggtgggggaccggttcccctacgacgtaccttccgttccgttagtttaccgcccgttcgtggtacctttcctaccgtttacgtaaggtttagtttaccttccgtttcggccttaccggttcgggtccctacgtaccggtcctaccggagggtaccggaaggggtcgtaggggtagggttcggggtacggtacgttagtttacgtcgttacgttagtttagggaagtagggaaactaaaacttaaaacgttaaaacgtaccgtaaacgtaacggtaaccggttacccgggtttaccccggggttacccgggtaaccttacttaaccccgaaccttaacccgttacccgtaaaacccgtaaaaggttaaacctttaaaggtttaaaccggaaaaccgttaaccggtaccgtttaccgttttaaggtttaccgaaacgtaaaccgtaaaagtccgtaaaaccncggtaaccgtaggtaacggtacgtaacggtaacgggaaccggtaccgtagggttaccgtttagtacggttttaaactttccgggtttcgttttcgggtttacgttccggttacgggttaaccggttacggggtaaccgttaacctaccggttcggagtcccgggtaccgggg

SEQ ID NO: 59067 - DNA, 627 bp, Homo sapiens
  misc_feature: GYAE6OF01B0N3H.10.53.E09.1.454.CMB.1.raw
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
tcagcatagtagtgcacgaccggtgctcgatttagagagagtgtgttgggtttgggctgagcgtgggttttccgtcgttaggctcttttaagaggtgtccagtgtcaggtgcagctggtggagtctgggggaggcgtggtccagcctgggaggtccctcagactctcctgtttagcctctggattcaccttcagtagttatcctttgcactgggtcctcaggctccaggcaaggggctggagtgggtggcagttatctcattttgatggagacaaataaatactacagagactccgttcggggccgattcacagtactaccaaaagacaatttgaaagaacgtacgacttgtttctgtcaaaatgaaacaacgcctagganagctggaggacacggctagtgtattactggtttacgtttggttccngtaccgtcggttaccggggtaagtaccctttcaacgctaccgtggggaccaggggtaccacccgtggttccaccgtcttcctcaacgtccctaccaccgtaacgggacccctagttaccggtccttacccccgtaggccctaccccttcccaccgtaacgacgaccgtaaccctccggtaggggcaaccgtgacccgggg

SEQ ID NO: 59068 - DNA, 663 bp, Homo sapiens
  misc_feature: GYAE6OF01ASLD1.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctgcctgtgtctcgtgggcgaggacggccaccatacaactgaccaacgtccacgccaggtagtttgttttactcacgcctaccgaactaaagtaacgtaacttacttacgtcgttacggaccacgacaaacgaaccgaggaccacgtacctaccgtaagctcgctactacgttacgcggcctacgtacccggtaacccgggtacgttccccgggtaccctacggtaccgtacgttacggacggtcggaccggtacgggtcggggtcggtacgggtaccgtagttacctttaccgaccttcctaccaccgtactcgacgcgacgtccgtacgaccgaggctaggaacgtcgtcggacgttacgttagtttactacgtcgtacgtcgtacttaacttacgttaccgtacctaccctgttactaccgtacgtcccggtaccgtaacggacgaacgtaggactacgaacgaaactggtcggcgtccg

SEQ ID NO: 59069 - DNA, 678 bp, Homo sapiens
  misc_feature: GYAE6OF01BRZAD.10.53.E09.1.454.CMB.1.raw
tcagcatagtagtgcacgaccggtgctcgatttagagagagtgtgttgggtttgggggacaacaggcaggcaggggcagcaagatggtgttgcagacccaggtcttcatttctctgttgctctggatctctggtgccgtacggggacatcgtgatcgacccagtctccagacctccctgcctgtgtctcgtgggcgaggacgggcccaccatcaactgacacgtccagccagtagttgttttatcagctaccgaacaaataacgtaacttacttagcttaggacagacaacgaaccgagacacgcctacagctcgctactagtttacgcggactacgtacccggtaaccgggtaccgtcccggggtacctacggaccgtacttcgacgggtcgacggtacggtacgggtccggtacgggactaacggttacctttaccgacttccgtaccaacctactacgacgacgtacgccgtcggaacgtcggtatagggaacgtgtaccggacgtaacgtttagttttactcgtcgtaacgtacaccgtttaacttagtttaaaccgtacctaaccccttgttacccaaccgttccggtttacccggaccggtacggtaaaccgtaaggttccggaaataaccgaaacgtaaccggtaggttcggtacgtccgtaccgtacccg

SEQ ID NO: 59070 - DNA, 809 bp, Homo sapiens
  misc_feature: GYAE6OF01AZGIW.10.53.E09.1.454.CMB.1.raw
  modified_base (158)..(158): a, c, t, g, unknown or other
  misc_feature (158)..(158): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagccgtgggacggtccctnagactctcctgtttagcctctggattccacctttcagtacgttatcctttgctacgtgggtcctcaggcctccgaggcgaaggggtctgggaggtgggtgctagttctctctatttgagtggaacgaacaagtaaatactaacgagacgtaccgtccggttcgggaccgtacgttccaaccgtacttaccgtaccaaaacgtaaccttaaacgtttacggaaaacgtaaaccgtacgtccgtttacgtttcgtacgacgtaaaagtacgaaacctacggtaccgtaggacgtacgtacgttacggaacggaaccgtcgggtcgttagttacgtttaacgtttacgtttcggttttaccggttttcggttaccggttacgttaccggttcccggggttaacgggggtaacttaacccgttacgaaccgggtcccgtaaccgggtcgggacccggtaccgggtacccgtaccccggttaccggtcccgtaacccgttcctacccgtacccgtccgaccccgtacccgaacccgaccggtcccgtacggttccccgtcccgttacccccgtccggacccctacccctcccgaccgtaacgacccgtacccgtaacccggttcgggtaccgggacccacggtcccggtccccggg

SEQ ID NO: 59071 - DNA, 792 bp, Homo sapiens
  misc_feature: GYAE6OF01EL92C.10.53.E09.1.454.CMB.1.raw
  modified_base (188)..(188): a, c, t, g, unknown or other
  misc_feature (188)..(188): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtntctgtgggcgaggacggccacatcaactgacaacgtccagaccagtagtttgttttatcagcctaccgaacaaagtaacgaacttacgttagctttacggtaacccagacaaacgaaacccgaggaaccgacgtaccttaccgtaaacggcctaggtaccttacgttaagttttacccggtacggggtaacctaacgttaacccgggtaaacccccggggtaaacggttcccccggggtacccttacggaaccccggttaatttccgggaaagggttcccgggcgtacggggtacgggggtccgtaacggggtaactaaggtttacctttacccgacttccctacctaaccacgtaccgaagtaccgaccggtcccgtacggacgtaccgggtacgtaaacggagtaccggtagggtacccgttacgttaacggtttttactaaccgttagtacctaacgtaccttaaacgttaactttaacgtaacccggttaaccccttaacttacctaaccgttaccgttcggggtaacccggttaaccggaaacggtaacggtaggtaaacgtacgtaaaccgtaaaacgggtacctgggtccggtaccg

SEQ ID NO: 59072 - DNA, 671 bp, Homo sapiens
  misc_feature: GYAE6OF01BIY5Y.10.53.E09.1.454.CMB.1.raw
  modified_base (240)..(240): a, c, t, g, unknown or other
  misc_feature (240)..(240): n is a, c, g, or t
  modified_base (653)..(653): a, c, t, g, unknown or other
  misc_feature (653)..(653): n is a, c, g, or t
  modified_base (663)..(663): a, c, t, g, unknown or other
  misc_feature (663)..(663): n is a, c, g, or t
tcagcatagtagtgcacgaccggtgctcgatttagagagagtgtgttgggttggggacaacaggcaggcaggggcagcaagatggtgttgcacgacccaggtcttctatttctctgttgctctggatctcgtggtcgccgtacgggacatcgtgatcgacccagtcctccagacctccctgcctgtcgtctcgtgggcgaggacggccacatcaactgacacgtccagccagtacgtttntttactcgagtcctacgaaactaataacgtaactacgttagcgttacggaaccagacaacgaaaccgaggaccacgtcctacgtaacgctacgcttactacttacggtcggactacgtacccggaacccgggtacggtcccggttaccacggtaccgtacgtcggaggtcggacggtagggtaccgggtacgtagggtaacctacggttaccttacctaccgtactccaactacgtcgaacggtcacggccgtacgccggtaaggtacaacgggaatcgggtacgtacggtacgtttattacgtacgtcgacgactacgttaattaacgttaactccccgttacctatcgtaaccgtccggttaacccggacccgtaaggtaaccgaaggtcaaacgttaccacgtaaacggngtcggcgtcngtaacccg

SEQ ID NO: 59073 - DNA, 956 bp, Homo sapiens
  misc_feature: GYAE6OF01AWQMH.10.53.E09.1.454.CMB.1.raw
  modified_base (188)..(188): a, c, t, g, unknown or other
  misc_feature (188)..(188): n is a, c, g, or t
  modified_base (247)..(247): a, c, t, g, unknown or other
  misc_feature (247)..(247): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctgattcaccttnagtagttattcctttgcactcgggtccgtcaggcctccgaggccgaagggggctagggnggtgggggtcggcgtagtttatccttctagttttgagtaggacgaaactaaagtaaaactaacttaacgaagacgtaccgttcccgggttacgggggtccacgtttaccaaccgtaactccgtaaacctaaaacggtaacctaaaagttttacgaaaacgggtaaacctaccggttacgttttacgttttaccgttacggtaacctaaaacgttaccgaaacgaacgtcccgtagtaacggtacggacgtaacggaacggaacgtaccggtcgttcggttaagtttagtttaccgtttggtttacgggttttcgggttacgtacggttaccggttaccggggttaaccgggggtaacctttacccggtttacgaaccgggttccgtaaacccggggttcggggacccggtacccgggtacccgtacccccgggtttacggtaccccggtaaccgttccccgttacccgtaccccgtacccgggtaacccccgttaaccccggtaaccccgggtaaccccgggtcccccgttaaccgtttcccccgggttttaccccccgttccccccgggttacccgggtacccccttacccccccgggttaccccgtaaacccccgtaaccggggtacccccgttaccccggttaaaccccggttcccgggggttaccggggcccctaaaccccgggtacccggggtccccccggggg

SEQ ID NO: 59074 - DNA, 963 bp, Homo sapiens
  misc_feature: GYAE6OF01BM2HT.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgtgctctggatctcgtggtcgccgtacggggacagtcgtgatcgaccctagtcctaccagtaccctccctcgtcctgtcgttcctcggtcggggaccgaggaccggaccaaccgtataccaacgtgacctaacgtccacggctagtagtttgttttaactcgacgcctaccgaactaaagttaacgtaaacttacgttacgtcgtttacggaccgacgtaacaaacgaaacccgtaggaaccaccgtcccttaccgtaacggtccttacgtccttaaccgttacgttttaaccgggtacggtacccgtaaacgtttaccccccgggttaaaccccggggttacccgggttacccccggggttaccccttaacgggacccgttaacgtttaccccggaagggttccgggacccggtaccgggggtaccggggttaaccgggttacggggaaaacccgtttaccggttaaccctttcccgtaacccgttttaccgaaacccccgttaacccctaaacgggttccccgaaacgtacccggtacgggtacccccggttaacgggaccggtaacgggtaccggttaaagggtaaaccccggttaagggtcccggggttaccccggttaattttaacggtttttaccctaaaccggggtttccgtaaccttaacgttaaaccccgtttaacgtttaccgttaaaccgttaaccctaaccccgttaccgtttaccaaccgggtttaaaccccggtccccgggttaacccgggttaaacggaacccgggtttaaacggtagtaaaccgggtaaccttaaacccggaaacggttcggttagggtaccgtaccg

SEQ ID NO: 59075 - DNA, 771 bp, Homo sapiens
  misc_feature: GYAE6OF01D4YQV.10.53.E09.1.454.CMB.1.raw
tcagcatagtagtgcacgaccggtgctcgatttagagagagtgtgttgggtttcctcgttgctcttttaagaggtgtccagtgtcaggtgcagctggtggagtcgtgggggaggcgtggtccagccgtgggaggtccctcagactctcctgttagcctctggattcaccttcagttagttatcctttgcacgtgggtccgtcaggtctccgaggcgaaggggctggaggtggggtggctagttactctactagttgagtaggagaacaaataagtactacgaagacgtaccgtccgggtacggggcctaacttccgaacctactacctaaccgaaaaggtaacctaaagtttacgaaaacggaacctacggtcctttacggttttacacggtaactaaaagttacgaaaaccgtacgtaccgtaggaacgtacgtacggtaacggaacgggaaccgtacggtcgttaggttacgttaactttacgttcgggttttacggtttcgttcgtacggtacggttcgggtaacgggtaaccttaccgtacgacgtacgtacggtcggggaccgtacgggccctaccggtcggtaccgtacccgtcctccctacgaccgtcccgaaccgaaccgtacccgggacctcggttccccgtcccttaccccgcgtcccaccctaccgtaccgaacgtaccgaccgttacccggtcgggtacggggacccaccgggaccggtcccgggtacccggtcgggtccgtcccgggtcgttaccggg

SEQ ID NO: 59076 - DNA, 689 bp, Homo sapiens
  misc_feature: GYAE6OF01AV0U3.10.53.E09.1.454.CMB.1.raw
  modified_base (315)..(315): a, c, t, g, unknown or other
  misc_feature (315)..(315): n is a, c, g, or t
  modified_base (640)..(640): a, c, t, g, unknown or other
  misc_feature (640)..(640): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtcctccagacctccctgcctgtcgtctcgtgggcgagacgggcccaccataccaacgtgacaacgtccagccagagttgtttatcagctccgactaataacgaactacttagtccttacggtaaccagacaacgaaaccgacggaacncgtcctacctaacgctcgcctctaagtttacgtgggtacctacgtccggtaacccgggacgttccccggggtcctacgaccggtattcgacggtcggaccgagggtccgggtacgtacgggactaggtactttcgacttaccgtcacctactccgaagtccgtacgccgttgaccgacggtacctaggaagtaggaccgtcgtacgttaaggtttacgttaacgtcgtaccgaagtaccttaagttaacgtttacgtaaccgtacccctaatttaccgaacgttacgttccccgggacccgttaacgggaaacccttaaacgggnggaaaccgtaacgttaaccaaaacccgggttacttagggtcggtaaccg

SEQ ID NO: 59077 - DNA, 1031 bp, Homo sapiens
  misc_feature: GYAE6OF01CWWWP.10.53.E09.1.454.CMB.1.raw
tcagcatagtagtgcacgaccggtgctcgatttagagagagtgtgttgggtttgggctgagctgggttttcctcgttgcttcttttaagaggtgtcctagtgtcagggtgcagcgtggtggagtcggtggggggaggcgtggtaccaggccgtgggacgtccctcagtacttctccttgtttacgccttcgtggtacttcctaccttactagttagtttacttccttggccgtacggttcgggttcccggtcacgggtcctcggacgggaccggtaagggggtcctggggtagggttggggtggtacttacgtttactccgttattacgtttgacgttagggaactaaacaaattaaaacttacgtaacgaagtaccgggtaccgttccgggggtaccgggtacccttacttacccgaaccctaacgttaccttaaaccgaaaacgtaaccgtttaagtttaacggaaaacgtaaaccgtccgttacggttgttcgtacgtaacctaaagtactaaaccggcgtaccggtaggaacggtacgtacggtacgggaaccggggtaccgtacggttacgtttacgggtttaagttttaccgtttaccgggtttttcgggttttttacggttttccggggttaaccgtccgggttaacggggtacccgggggtttaacccgggtaactttaaccccgggtggtaaccccggtaccggggttaacccgggttacgggggtacccccgtaacgggttaccccccgtacccgggtttccgggttaccccgttacctttcccccgggttaccccgtaccgttaccccgggttaaacccccttacccgggaaacccccggggtccgtttaacccccggtccccccggttttacccccgggttcccccctttacccccgggggacccctttcccccggtacccctttaacccgggtaccgaccgggttaacccccggttcccgtaccccggggttaacccggggcgggtaaaacccctcggggaacccccgggtccccggg

SEQ ID NO: 59078 - DNA, 749 bp, Homo sapiens
  misc_feature: GYAE6OF01D59FS.10.53.E09.1.454.CMB.1.raw
tcagcatagtagtgcacgaccggtgctcgatttagagagagtgtgttgggtttgggggagctacaacaggcaggcaggggcagcaagatggtgttgcacgacccaggtcttctatttctctgttgctcgtggatctcgtggtcgccgtacggggacatcgtgatcgaccctagtcctccagtacctccctgtcctgtcgtctcgtgggcgaggacggaccacatacactcgacaacgtccacgccgtaagtagtttgttttactcgacgtcctaaccgaactaaagtaaactaacttacttacgtcgtacggtaccagtaccgaaacgaaccgaacggaccgtaccgtaccctaccgtaagtccgtacgtaccttacttacgttacgtcgacctaccgtaccggtacccgggtaccggtcccgggtacctacgtaccgtacgtcggtacggtcggtacggacgggtccgggtacgtacggtaactacgttacctttccgaccttactacccgaacctagtaccgtcgaacgtaccggtcctacggacgggtacgtactaggtacgtcgtacggtacgttacttaagttacgttaccgtagtaccgtaataaccgtttacttaacgttacccctaacccgtcccttaaagtcccgttaacggtcccggttacccggaccgggttaaaccggaacgtaacggtagggtaaccctaaactaaaccggtaaccgtcgggttgcccgttaaccg

SEQ ID NO: 59079 - DNA, 953 bp, Homo sapiens
  misc_feature: GYAE6OF01AKYJ1.10.53.E09.1.454.CMB.1.raw
  modified_base (163)..(163): a, c, t, g, unknown or other
  misc_feature (163)..(163): n is a, c, g, or t
tcagcatagtagtgcacgaccggtgctcgatttagagagagtgtgttgggtttgggctgagcttgggttttcctcgttgcttcttttaagaggtcgtccagtgtcaggtcgcagcgtggtggagtcgtgggggagcgtggtccaggccgtgggacgttccctnagtaccttcgttccgttggtttacgccttcgtgggtactttccgacctttcgaaggttacgtttacttccgtttggccgtacggttcggggttccctacgacgggtcctaccggaaggggtccgaacggggggtcttggggacggtttcgggggtacggaccttaggttttactccgttacgttagttttggacgtacgggaactaacgtaaattaacgttaccgtaacgtacggtacgtacccggttccgggttccggggaccttacgttcccgaccgttacgttcccgtaacgtaaacggtacttaacggtttacggaaccgtaaccgtcggttccgttttacggtttaccgagtaccgttaaagtaccggtaaacctccgggttacgtacggaaggtacccgtaggttaacgggaaccgggtaaccgtcgggttaaccgtttgggttaccgtttaacgtttacgggtttcggtttttacggtttcggttacgttacgggttaccggttaccgggttacgggttaaccttaccgttacggacgtaccggtacgggccgggtaccgtaccgggtccgttaccggtcggttacccgtacccgttccgtacccgtacgtaccgtacccgttacccggaaaccgttccggtacccgtaccggttccccggttaccccttccccgggtaccggttaccccctaccccggtttacccgaccggtaaccgtacccggtacccgttacccgggttccgggaacccgggtccctaaccgggtcccgggtaccccggg

SEQ ID NO: 59080 - DNA, 666 bp, Homo sapiens
  misc_feature: GYAE6OF01BYTAM.10.53.E09.1.454.CMB.1.raw
  modified_base (373)..(373): a, c, t, g, unknown or other
  misc_feature (373)..(373): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtcctccagtacctccctgcctgtcgtctcgtgggcgaggacgggccaaccataccaacgtcgaacaaaccgtccacggacctaagtagtttacgttttatcgaacgtccttaccgaactaaagtaaacgaacttaaccgttagtcttacggtaccagacaaacgaaccgaggacacgtacctacgaagtctcgactactattacgnggtaccacgtaccggtaacccggtacggtcccgggtacctacggaaccgtacttcgacgtgggacgacggtcgggtacgtaggggactagtcttactacctcgtaccaccgtagactacgccacgtacgtcgcgtacggacgtaggagtacgtcgtacggtacttaaggtttactagtcgtactactaccttaattaacttactaccgtaccctagtacctaacgtcgttacccggaccgtaacggtacgaagtacggaacgtacgtaaaccgaacgtactcggtcgtaacgg

SEQ ID NO: 59081 - DNA, 734 bp, Homo sapiens
  misc_feature: GYAE6OF01CYNTZ.10.53.E09.1.454.CMB.1.raw
  modified_base (698)..(698): a, c, t, g, unknown or other
  misc_feature (698)..(698): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagccgtgggacggtccctcagcttcctcctgtttacgcctctggtacttccacctttcagttagttacttcctttgcacgtcgggtccgtcaggcctccgaggccgaaggggtctgggaggtcgggtgtcgtagttactctctattgagtagagaactaataaatactactagagtaccgtccggtacggccgacttccgacctagtacctaccgtaaaagaacctaagtttagaaactaaccgtacgtacgttagttactacgtaactaaacgtacgaaacacggtacgtacggaagtacgacgtacggaacggtacgacggtacgtgtttaggttacttacgttcgttttacggtttcggttacttacggtacggtcgggtaacggggtaaccttacgtagacgtccggtaccgggtaccgggtaccgtaccggcctccccggttcgaccgtaacccgttccgtcccgtacaccgtacccgtacccaaccgggtaccgcccgttaccgtcccgttacccgtccccgtccgtaccctccctacccgacaccggtaccnccgtaccgcggtacggaccgacggcggtaccccggg

SEQ ID NO: 59082 - DNA, 735 bp, Homo sapiens
  misc_feature: GYAE6OF01BLO0A.10.53.E09.1.454.CMB.1.raw
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (500)..(500): a, c, t, g, unknown or other
  misc_feature (500)..(500): n is a, c, g, or t
tcagcatagtagtgcacgaccggtgctcgatttagagagagtgtgttggggtttgggggagctacaacaggcaggcgaggggcagcaagatggtgttgcacgacccaggtccttctatttctctgttgctcgtggatctcgtggtcgccgtacggggactagtcggtagactcgacccagtcctccactacctcctggtcctgtcgtctcgngggcgagacggccactanaccaactcganaacgtccagaccagtnttcgtttacncgacgtctaaccgaactaaaataaacgtaaactttacgtacgtacgttaacggaaccgagacaaaacggaaacgacggaacaccgtaccctaacgtaagtcgtacgccttaatacgttttacggacgacgtaccgtaaccggtaaccgggtacgttccccgggtacgaacgacgtcgtacgtacggtcgaaccggcgggtttcgggactagggaaacttacgtacttaacccnccttacaacgtaaccacacgtacaccgacgtacaggaccgtcgacgtaagaacgtcggtacgtagtacgttaatttacggtaacgtcgtaacgacgtaaccttaagtaacttaccggtaaacccttaaccaaacttccgaacgtaccggttaaccccgggtaaccggtaattaaaccgggaaaggtacggttaaaaccggaacttaaccgtaaaacgggtacgtcggtaacacgg

SEQ ID NO: 59083 - DNA, 767 bp, Homo sapiens
  misc_feature: GYAE6OF01D9VP5.10.53.E09.1.454.CMB.1.raw
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagttttgggctgagcttggggtttttccctgttgcttcgtttttaaagaggtgtccaggtgtcaggtgcagcgtgggtggagtcgtggggggagcgtcggccagccgtgggacggtcccctgagaccttctccttggtttacgccttcgtggtacttcctacctttacgagttagtttacttccgtttgccgtacgttcgggtcccgtcgacggtcctaccgagggccgtaaggggcgtgggaggtgggtcggactaggtttctcgtacgtagtttacgagtaggaactaacgaaaattaaactaacgtaacgacgaacggtaccttcccggggtacgggacctacttaccgaaccctaagttaccctaaccgaaaagtaacctaacgtttaaggaaacgtaacctacgtacgtttacggtttacacggtaacaaagtacggaacacggacccgttaaggaacgtacggtacgtaacggacggacccgtacgggtcgttaggttacgttaacttttacggtttcggttttacgggtttttacggttccgttaacgggttaccggtttaccggggtaaccggggttaaaccgtttaccccgtttacggaacccgtcggtaaacccgggg

SEQ ID NO: 59084 - DNA, 800 bp, Homo sapiens
  misc_feature: GYAE6OF01AZHNW.10.53.E09.1.454.CMB.1.raw
  modified_base (124)..(124): a, c, t, g, unknown or other
  misc_feature (124)..(124): n is a, c, g, or t
  modified_base (168)..(168): a, c, t, g, unknown or other
  misc_feature (168)..(168): n is a, c, g, or t
  modified_base (277)..(277): a, c, t, g, unknown or other
  misc_feature (277)..(277): n is a, c, g, or t
  modified_base (761)..(761): a, c, t, g, unknown or other
  misc_feature (761)..(761): n is a, c, g, or t
tcagcatagtagtgcacgaccggtgctcgatttagagagagtgtgttgggtttggggagctacaacgaggcaggcgagggcagcaagtagtggtgttgcacgacccgtaggtcttctatttctntgttgctcgtgatctcgtggtacgccgtacggggactagttcgngtatcgacccgtacgtcctaccgtaacgccgttcccgtgcgtttcgtcgttccgtcggtcgggacgacggaccggaccctacacgttacacgtcgacgtacgtccgacncgtaagttagtttctttaacgtaccgacgtaccgttaccgaaactaaacgtaagtaacgttacgttacggtacgtacgtacgtaacgacgtaacaacggtacgacgtaactaccgtactaacgtcgtcgtaacttcgtacgtttcgacggtactaccgttaacgggtaacccggtcccggttccggtacccgttaggtacccgtacgttacgcgggtaacggtaccgtaggggtaccggttacggacggtaaccctaagggttaccctttacggtaccctcgtaaccccgacgttaaccgcttaaacggtccgaaaccgttccgaaccgtacgtaccggtaacgtaggacgtacgtcgtaccgggttattaacgtttaacgtagtaccgtacgttacctaacgtacgttaaccttacggtaaaaccttcctaaacgtacctacgtaaacccggtccgtaacggaacggttaacgaacggtaaancggttaaacgaacgttaacgtaccgttagggtctaaccg

SEQ ID NO: 59085 - DNA, 760 bp, Homo sapiens
  misc_feature: GYAE6OF01BQFP2.10.53.E09.1.454.CMB.1.raw
  modified_base (180)..(180): a, c, t, g, unknown or other
  misc_feature (180)..(180): n is a, c, g, or t
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (411)..(411): a, c, t, g, unknown or other
  misc_feature (411)..(411): n is a, c, g, or t
tcagcatagtagtgcacgaccggtgctcgatttagagagagtgtgttgggttggggacaacaggcaggcaggggcagcaagatggtgttgcagacccgagtcttcatttctctgttgctctggatctctggtgccgtacgggacatcgtgatgaccagctcagactccctgcctgtctcncgtgggacaggacgggccaccatacgaacgtcgacgacgttccgagacctagacggttnttttacacgtcggcctaccggaacaagtaaacgacttaacgtacgtcgtttaggaccaacggtcaacgtaaaacgnggaacacgtacctacgtaacgcacggtctagtaacgttcgagggtacaccgttacggaacccgggtaaggttcccggggtacctacgaacccggtntttaacccgggagggtttcgggtacccggaaacgggtcggggttaccccggtaaggggtacctaaaccgggttacttaccggtaccgtaccgttaccgtaacctacgtaacgtacggactaccggtaccgtaagcgacggtacgtaacggtaacggtaacgtacgtcgggtaaacgttagtttaaccgttaacgtttacgtacaacgtaccggttaaacttaacgttaacttaacccggaactttacctaccgtaccgttacgtaaccggtcccggtaacggtaaacaaacggttacggacgtaacgtaaaccgaagttaaaccgagtcggtaacggtccgtaaacccg

SEQ ID NO: 59086 - DNA, 1040 bp, Homo sapiens
  misc_feature: GYAE6OF01CKH3Y.10.53.E09.1.454.CMB.1.raw
  modified_base (138)..(138): a, c, t, g, unknown or other
  misc_feature (138)..(138): n is a, c, g, or t
tcagcatagtagtgcacgaccggtgctcgatttagagagagtgtggttgggtttcctcgttgctcttttaagaggtgtccagtgtcaggtgcagctggtggagtcgtgggggagcgtggtccagcctgggagtccctnagtactctccttgtttacgccttcgtggacttcctaccgtttacaggttaagtttacttccctttggactacggtcgggttaccgtcgagggcctaccggaggccggaagggggcctaggggacggtggggtcgacttagttactcgtactagtttgagttaggaacgtaactaaagttaaagtacgtaacgaaggacggtaccgttacccgggttaccgggggacctaatcccgaaccctaacgtaccgtaacccgtaaaaggtaacgttaaagtttacggaaacgtaaaccgtacgtaccgttttggtttaccgaacgtaacctaaaaggtaccgaaaccgtacggtaccgtacggaacggacgtaccggtagggaaccgggaaacctaccgggtaccgtttagggttaacgttttaacgtttacccgggttttcggtttacggggttttacctttacgggttaaccgttaccgggtttaaccggggtaacccggggggttaaactttaaccccgttaacggtaacgggttaaccccggtaaccggggtttacgggggaccccggtaaccggggtaccccgttaaaccccgggttcggtaacccccggttaacccgttacccgttaccccggtaccgtaccccgggtaacccctaacccggtaacccgggtaaccccggtccccgttaacccggtttcccccggttaccccggtttacccccgtacccggtacccccccgttaccccgttacccccgaaacccggttaaccggtaaccccggtacccgttaacccgggttacccgggggtaacgggtacccccgggaaccgggtaccccggggtaccccgggtacccgggttccgggttaacccgtccggggtaccccgttaaacccggg

SEQ ID NO: 59087 - DNA, 742 bp, Homo sapiens
  misc_feature: GYAE6OF01BVFP7.10.53.E09.1.454.CMB.1.raw
  modified_base (385)..(385): a, c, t, g, unknown or other
  misc_feature (385)..(385): n is a, c, g, or t
tcagcatagtagtgcacgaccggtgctcgatttagagagagtgtgttgggtttgggggagctacaacaggcaggcagggcagcaagatggtgttgcagacccaggtcttcatttctctgttcgctctggatctcgtggtgccgtacgggactagtcgtgatcgacccagtcctccgagacctcccgtgccgttgtcgtccgtcggtgggacgaggacggaccaccagtacactcgacaacgtccagcctagtgttagtttactcgacgtcctaccgaactaaataacgtaaccttacgtagtaccgttacggtaaccgacgtaccaaacgaaaccgaggaccaacgccctacgtaacgtctacgtacctacgttagtttaccggnggtacctacggtacccggtaacccgggtaccggttaccccggtccacggtaacccgtcgttacgacgggtcgacggtacgggtacgggtacggtacggactacgttaccgttactaccgtaccgtaccacccgttagaccgacgtaccgtacgtaccgtcggaacgtaggtcgaaggtaagtaccgtcggtaccgttagtttaacgttttactaccggtataaccgtacgttaacttaactttaacggtacctacccgttaacctctacgtaacccgtcggtacccggtacgtaacggtaacccgtaagggtccgttaaacgaccgtaaacggtaaaccggttctgggtccggtacc

SEQ ID NO: 59088 - DNA, 560 bp, Homo sapiens
  misc_feature: GYAE6OF02ITSF7.10.53.E09.1.454.CMB.1.raw
tcagcatagtagtgcacgaccggtgctcgatttagagagagtgtgttgggtttgggctgagcgtggtttcgtcgtaggctctttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacaacgctgtttctgacaaatgaaacagcctgagagctgagacacggctgtgtattactgttcgtttgttctgctcgtcggggaatactcagcacgtgggccagggccacccgtggtcaccgtctcctcacgcctcccaccgaacgggcccagttccggtccttcccccgtgggccctaccccgtccctccaacgacgccaccgttccgtgggggcctacgaggccccggg

SEQ ID NO: 59089 - DNA, 556 bp, Homo sapiens
  misc_feature: GYAE6OF02HZX0H.10.53.E09.1.454.CMB.1.raw
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaataccttcagcactggggcagggcaccctggtcaccgtctcctcagcctccaccaacgggcccatccggtccttccccgtcggccaccctccctccaacgacgccaccctcgtcgggggccaccgacggccggcccgtcggggcctcggcccgtcggg

SEQ ID NO: 59090 - DNA, 536 bp, Homo sapiens
  misc_feature: GYAE6OF02I7TIP.10.53.E09.1.454.CMB.1.raw
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctggggaggtccctcagactctcctgtttagcctctggattcaccttcagtagttatcctttgcactgggtccgtcaggctccaggcaaggggctgggagtgggtggcagttatctcattgatggagacaataaatactacagagactccggttcggggccgatcaccatctccaaagacaatttagaagaacacgctgttctgacaaatgaacagcctagagagctgaggacaacggctgtgttattacgttgttcgtttggttacttgacgttcggtcggggaattaccgttcacgctacgg

SEQ ID NO: 59091 - DNA, 523 bp, Homo sapiens
  misc_feature: GYAE6OF02HILKG.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatcccgggtccctgaccgattcagtggcagcgggtctgggacagatttcactctcaccatcagcagcctgcaggctagaagatgcggcagtttattactgtcagctactattactacgtaccccattaccactacgttccggcccgtagggaacctaaaggtggaagactaccaaaccggaacttggtaggtccg

SEQ ID NO: 59092 - DNA, 541 bp, Homo sapiens
  misc_feature: GYAE6OF02FR1JM.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaataccttcagcactggggccagggcaccctggtcaccgtctcctcagcctccaccaacggcccatccggtctcccctggccaccctcctcccaacgacgccacctccgtcgggggcaccgagtcccgg

SEQ ID NO: 59093 - DNA, 567 bp, Homo sapiens
  misc_feature: GYAE6OF02IFBNA.10.53.E09.1.454.CMB.1.raw
  modified_base (362)..(362): a, c, t, g, unknown or other
  misc_feature (362)..(362): n is a, c, g, or t
tcagcatagtagtgcacgaccggtgctcgatttagagagagtgtgttgggtttgggctgagcgtgggtttccgtcgttagctcttttaagaggtgtccagtgtcaggtgcagctggtggagtctgggggaggcgtggtccagcctgggaggtccctcagactctcctgtttagcctctggattcaccttcagtagttatcctttgcactgggtcctcaggctccaggcaaggggctggagtgggtggcagttatctcatttgatggagacaataaataactacagagactccgttcgggccgattcaccatctccaaagacaatttgaagaacacgctgtttctgacaaatgaacagcctgnagctgagacacggctgtgtattactgttcgtttggttctgtacgtcgtcgggggaataccttcagcacgtgggccaggcaccgtggtcaccgtcgtctcagcctccaccgaacggcccacgttccggtccttcccccttcgggcctaccccgtcccttcccaacgtaccggcctaccgtccgtcgggggccaccgaggccccggg

SEQ ID NO: 59094 - DNA, 511 bp, Homo sapiens
  misc_feature: GYAE6OF02HR7AP.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccgggtccctgaccgattcagtggcagcgggtctgggacagatttcactctcaccatcagcagcctgcagctgaagatgcgcagtttattactgtcagcacttattatacgttaccccattcactagttccggcccgtgggaacccaaggtggacgactaccaaacggaactggtaggtac

SEQ ID NO: 59095 - DNA, 528 bp, Homo sapiens
  misc_feature: GYAE6OF02I08U8.10.53.E09.1.454.CMB.1.raw
  modified_base (308)..(308): a, c, t, g, unknown or other
  misc_feature (308)..(308): n is a, c, g, or t
  modified_base (522)..(522): a, c, t, g, unknown or other
  misc_feature (522)..(522): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcaagaaaccaggacagcctcctaagctgctcatttacngggcatccgtacccgggaatccggggtcctgaccgattcagtggcaggcggtctgggacagactttcactctcaccatcagcagcctgcaggctagaagatcggcggactagtttattacgtgtcaagctaatattactacgtaccctattccaactcttccggcccgtgggaacctaaaggtcggaagactacgaaacgtacgtggtcggtcncgtacc

SEQ ID NO: 59096 - DNA, 489 bp, Homo sapiens
  misc_feature: GYAE6OF02IY4VH.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaagctgctcatttactgggcatctaccgggaatccgggtccctgaccgattcagtggcagcgggtctgggacagatttcactctcaccatcagcagcctgcaggctgaagatgcggcagtttattactgtcagcatattatagtaccccattcactattcggccctgggaccaagtgagatacaacgatgtggctgacc

SEQ ID NO: 59097 - DNA, 542 bp, Homo sapiens
  misc_feature: GYAE6OF02HNL26.10.53.E09.1.454.CMB.1.raw
  modified_base (153)..(153): a, c, t, g, unknown or other
  misc_feature (153)..(153): n is a, c, g, or t
  modified_base (464)..(464): a, c, t, g, unknown or other
  misc_feature (464)..(464): n is a, c, g, or t
tcagcatagtagtgcacgaccggtgctcgatttagagagagtgtgttgggtttgggctgagcgtgggttttcctcgttgctcttttaagaggtgtccagtgtcaggtgcagctggtggagtctggggagcgtggtccagcctgggagtccctnagactctcctgtttagcctctggattcaccttcagtagttatcctttgcacgtgggtcctcaggctccaggcaaggggctggagtggggtgcagttatctcatttgatggagacaataaaatactacagagactccgttcggggccgattcaccatctccaaaagcaatttgaaagaacagctgtttctgcaaatgaacagcctgagagctgagacacggctgtgtattactgttcgtttggttctgtactcggtcggggtaataccgttcagcaacgtgggccagggcacccgtggtcaccgtcctctcncgcctccaccacggcccatcgtccttccctcggcaccctcctccaacgacgccaccgtcctcggggcacgacgcccgg

SEQ ID NO: 59098 - DNA, 542 bp, Homo sapiens
  misc_feature: GYAE6OF02FXBZ5.10.53.E09.1.454.CMB.1.raw
tcagcatagtagtgcacgaccggtgctcgatttagagagagtgtgttgggtttgggctgagctgggtttcctcgttgctcttttaagaggtgtccagtgtcaggtgcagctggtggagtctggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccattcaccatctccaaagacaatttgaagaacacgctgtttctgcaaatgaacagcctgagagctgaggacacggctgtgtatactgttcgttggttctgactcgtcgggggaataccttcagcacgtggggccagggcaccctggtcaccgtctcctcagcctccaccaaagggcccatcggtccttccccgtcggccaccctccctccaacgacgcaccctccgtcggggccacgagcccggg

SEQ ID NO: 59099 - DNA, 491 bp, Homo sapiens
  misc_feature: GYAE6OF02IBMPJ.10.53.E09.1.454.CMB.1.raw
  modified_base (312)..(312): a, c, t, g, unknown or other
  misc_feature (312)..(312): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttacnggcatctaccgggaatccgggtccctgaccgattcagtggcagcggtcngggacagatttcactctcaccatcagcagcctgcaggctgaagntgcggcagtttatactgtcagcactatatacgtacccattcactatcggacccgtggaccaagtgagatacaaacggactgtgtcc

SEQ ID NO: 59100 - DNA, 173 bp, Homo sapiens
  misc_feature: GYAE6OF02IPQXE.10.53.E09.1.454.CMB.1.raw
  modified_base (173)..(173): a, c, t, g, unknown or other
  misc_feature (173)..(173): n is a, c, g, or t
tcagcatagtagtgcacgaccggtgctcgatttagagagagtgtgttgggtttgggggaagaggaagactgacggtcccccaggagttcaggtgctgggcacagcggccctgggctgcctggtcaaggactacttcccactactatgctgagcgggctggcaaggcgcatagn

SEQ ID NO: 59101 - DNA, 507 bp, Homo sapiens
  misc_feature: GYAE6OF02J034G.10.53.E09.1.454.CMB.1.raw
  modified_base (309)..(309): a, c, t, g, unknown or other
  misc_feature (309)..(309): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaagctgctcattacngggcatctaccgggaatccgggtcctgaccgattcagtggcagcggtctgggacagatttcactctcacatcagcagcctgcaggctgaagatgcgctagtttatactgtacagtctactattactacgtacccattcactacgttccggccctagggaccctaagtggacgtactaccgaaacgacttggtagtacg

SEQ ID NO: 59102 - DNA, 543 bp, Homo sapiens
  misc_feature: GYAE6OF02JCN12.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaagctgctcatttactggcatctaccgggaatccgggtccctgaccgattcagtggcagcggtctgggacagattcactctcacatcagcagcctgcaggctgaacgatgcggctagtttatactgtacagctactattactaacgtaccctattccaactacgttccggtacccgttacgggaaacccgtaaaggttacggaacgtaacgttaaccgaaaaccggtaacgttacgggtacggtaccg

SEQ ID NO: 59103 - DNA, 601 bp, Homo sapiens
  misc_feature: GYAE6OF02IVEQX.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcgggccgattcaccatctccaaagacaatttgaagaacacgctgtttctgcaaatgaacagcctgagagctgaggacacggctgtagtattactgttcgtttggtcttgacgtcggtcgggggtaacttaccgttcgacgtctaacgtggggcccagggccacccgtcggtccaccgttcctcctccgacgtccctccaaccacgggcccacgtccggtaccttccccgtccggcccaccccgttccctacccgaacggtacgcccgaacccgttccgtaccggggaccgtaccgacggtaccccggg

SEQ ID NO: 59104 - DNA, 580 bp, Homo sapiens
  misc_feature: GYAE6OF02ID2WG.10.53.E09.1.454.CMB.1.raw
  modified_base (383)..(383): a, c, t, g, unknown or other
  misc_feature (383)..(383): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaaatactacagagactccgttcggggccgattcaccatcctccaaagacaatttgaagaacacgctgtttctgcaaatgaaacagcctgagagctgaggacacgcgggtntgtattactgttcgtttggttctgactcggtcggggaataccgttcagcacgtcggggccgagggccaccgtggtccaccgttcctcctcgacgtccctcccgaaccaacgggccccacgtccggtccctttccccccgtggccctacccctccctacccgaacgacgccacctccgtcggggcctacgcgcccggg

SEQ ID NO: 59105 - DNA, 568 bp, Homo sapiens
  misc_feature: GYAE6OF02GV1VQ.10.53.E09.1.454.CMB.1.raw
  modified_base (343)..(343): a, c, t, g, unknown or other
  misc_feature (343)..(343): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtggggtggcagttatctcatttgatggagacaataaatactacagagactccgtcgggccgattcaccatctaccaaagacaatttgaagaacacgctgtttcngacaaatgaacagcctgagagctgagacacggctgtgtattactgttcgtttggtctgactcggtacggggaataccgtcacgctacgtcgggccagggccacccgtggtccaccgtctccctcacgccctccaaccgaacggccctacgtccggttcccttcccccgtggccctaccctccctacccaacgccgacctaccgtcggcggggccacgcgcccggg

SEQ ID NO: 59106 - DNA, 552 bp, Homo sapiens
  misc_feature: GYAE6OF02GB2GH.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaaagacaatttgaagaacacgctgtttctgcaaatgaacagcctgagagctgaggacacggctgtgtattactgttcgtttggttctgactcggtcgggggaataccttcagcacgtggggccagggcacccgtggtcaccgtctcctcacgcctccaccaacggcccagtccgtccttccccgtcggcccaccctccctcccaacgacgccaccgtccgtcggggcacgagcccgg

SEQ ID NO: 59107 - DNA, 504 bp, Homo sapiens
  misc_feature: GYAE6OF02FLSZQ.10.53.E09.1.454.CMB.1.raw
  modified_base (412)..(412): a, c, t, g, unknown or other
  misc_feature (412)..(412): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaccaggacagcctcctaagctgctcatttactgggcatctacccgggaatccgggtcctgaccgattcagtggcagcgggtctgggacagatttcactctcaccatcagcagcctgcaggctgaagatgcggnagtttatactgtcagcactattatacgtaccccattcacagttccggccctagggaaccctaaagtcggaagataccaaacgactggtgtcg

SEQ ID NO: 59108 - DNA, 527 bp, Homo sapiens
  misc_feature: GYAE6OF02GDRDI.10.53.E09.1.454.CMB.1.raw
  modified_base (409)..(409): a, c, t, g, unknown or other
  misc_feature (409)..(409): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatcccgggtccctgaccgattcagtggcagcgggtctgggacagatttcactctcaccatcagcagcctgcaggctgaagntgcgcagtttatactgtcagcacttattaatacgtacccattccaactacgttccggcccgttagggaaccctaaaggtggaacgtaactaccgaaaacggtacttggtacggtaccg

SEQ ID NO: 59109 - DNA, 551 bp, Homo sapiens
  misc_feature: GYAE6OF02HUDY7.10.53.E09.1.454.CMB.1.raw
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggtctgactcgtcggggaatacttcagcacgtgggccagggcaccgtggtcaccgtctcctcacgcctccaccgaacggcccagtccggtccttcccccgtggcccaccctcctccaacgacgccacctcgtcggggccacgcggccggcccgtgggcctcggccgtacggg

SEQ ID NO: 59110 - DNA, 668 bp, Homo sapiens
  misc_feature: GYAE6OF02F48CW.10.53.E09.1.454.CMB.1.raw
  modified_base (91)..(91): a, c, t, g, unknown or other
  misc_feature (91)..(91): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
tcagcatagtagtgcacgaccggtgctcgatttagagagagtgtgttgggtttgggctgagcgtggtttcgtcgtagctctttaagaggtntcagtgtcaggtgcagctggtggagtctgggggagcgtggtccagcctgggaggtccctcagactctcctgtttagcctctggattcaccttcagtagttatcctttgcactgggtccgtcaggctccaggcaaggggctggagtggggtggcagttatctgatttgatggagacaataaatactaacagagactcggttcggggaccattcaccatctaccaaagcaatttgaagaacacgntgtttcngactaaatcgaacacgctgagagcgtgacggacacggctggtagttattacgttgtttcggttttcggtttctagtaacgttcgggttacgggggtaaacttaaccgtttcgagcgtaaccggtcgggggacccgaacgggggtccctacccgttcgggttaccctacccggttacctcccgtccgaacggccccttacccgaaccgaaacgggcccctaacgttcccgggttccttcccccgtacggtcccctaccccgttcccttacccgaacggacgtacccgtaccgttaccgggtcgggggaccctaccgacggtccccggg

SEQ ID NO: 59111 - DNA, 525 bp, Homo sapiens
  misc_feature: GYAE6OF02IXPI6.10.53.E09.1.454.CMB.1.raw
  modified_base (373)..(373): a, c, t, g, unknown or other
  misc_feature (373)..(373): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccgggtccctgaccgattcgagtggcagcgggtctgggacagntttcactctcaccatcagcagcctgcaggctagaagatgcggctagtttattacgtgtcagctacttattatacgtacccctattcaactacgttccggacccttgggaaccctaaggtggaacgtactaccgaaacgtaactggtacgtcg

SEQ ID NO: 59112 - DNA, 640 bp, Homo sapiens
  misc_feature: GYAE6OF02GOEOS.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgacaagtccagccagagttgttttatcagctccgacaataagactacttagcttcggtaccgacgacacgaaaccgaacggaacgacgaccgtacctaacgacgtcgccgtctactttacgtgggaccgtactaccgtacccgggtaacgtacccgggtcccgtacgaccggtacgttactacggtggcgagtcgggtcgtcgggacgacgtagtttccactctccaacctacgtcacgcacgcctcggcaggctagaagatcgcggtacgtagttttaagtacttgaccagtaccgtaattaacgtttaatacccgttaacccctatttacaccgttagttcccgggtaccccgttaaggggaaccccgttaaagttggggaacgtaacctaacgtaaaaacccggtacgttgggtacggtaccg

SEQ ID NO: 59113 - DNA, 538 bp, Homo sapiens
  misc_feature: GYAE6OF02GETCQ.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctggggaggcgtggtccagcctgggaggtccctcagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctactttgtgcgactagaagtgggagctatagggatttgattcctgggccagggaacccgtggtcaccgtctcctcacgcctccaccaacgggcccactcggtccttccccctcggccaccctccctcccaacgacgccaccgtcgtcgggggcaaccgg

SEQ ID NO: 59114 - DNA, 650 bp, Homo sapiens
  misc_feature: GYAE6OF02GCLZ7.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgacgtcgtcggggtaataccttcagcacgtggggtccagggccacccgtcgggtccgtacccgtcctccctccgacgccccttacccgaacccgaaaccgggtaccccgtaacgttcccgggttaccctttccccccggttcgggtcccctaaccccccgttccccgtaaccccgtaaaccggtaaccggtaccctaaccccggttcccggtaccgggggggccctaaccggacccggtcccccggggg

SEQ ID NO: 59115 - DNA, 582 bp, Homo sapiens
  misc_feature: GYAE6OF02HEQNT.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctgggagtggggtggcagttatctcatttgatggagacaataaatactaacagagactccgttcggggccgattcaccatctaccaaagacaaatttgaaagaacacgctgtttctgcaaatgaaacagcctgagaagctgagacacggctgtgtattactgttcgtttggttctgtacgttcggtacgggggtaataccgttacgagactacgtggggccagggcaccgtcggtccaccgtctccgtcacgcctccaccgaacggacccacgtccggtccttccccgtcggccctaccctccctaccaacgacgaccgaccgtccgtacggggaccacgacgcccggg

SEQ ID NO: 59116 - DNA, 501 bp, Homo sapiens
  misc_feature: GYAE6OF02F50KQ.10.53.E09.1.454.CMB.1.raw
  modified_base (409)..(409): a, c, t, g, unknown or other
  misc_feature (409)..(409): n is a, c, g, or t
  modified_base (497)..(497): a, c, t, g, unknown or other
  misc_feature (497)..(497): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccgggtccctgaccgattcagtggcagcgggtctgggacagatttcactctcaccatcagcacgcctgcaggctgaagntgcggctagtttattactgtcagctactattatacgtacccattcactacgttcggccctagggaccaaggtgagatacaacgactgnggtc

SEQ ID NO: 59117 - DNA, 491 bp, Homo sapiens
  misc_feature: GYAE6OF02JGR80.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggctagtttatactgtcagcactattatacgtaccctattcactattcgcctggaccaagtgagatacaacgactgtgctgacc

SEQ ID NO: 59118 - DNA, 608 bp, Homo sapiens
  misc_feature: GYAE6OF02ITN1I.10.53.E09.1.454.CMB.1.raw
  modified_base (246)..(246): a, c, t, g, unknown or other
  misc_feature (246)..(246): n is a, c, g, or t
  modified_base (384)..(384): a, c, t, g, unknown or other
  misc_feature (384)..(384): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctggattcaccttcagtagttatcctttgcacgtgggtccgtcaggctccaggcaaggggctggagtgggngcagttatctctattgatggagacaaataaatactacagagactccgttcggggccattcaccatctaccaaagacaatttgaagaacacgctgtttctgacaaatgaaacagcctaggagagctagacggacacggntgtagtattactgtttcgtttggttcgtgtacgttcgggtacgggtaacgttaccgttcgacgtcgacgttcggggccctacgggcctacccgtcggtccaccgttcctccctacacgccctccgaccgaacggccctacgtccggtcccttcccccgtcggtccccacccctccctacccaacgacgtacccaccgtccgtacggggccaccggcgccccggg

SEQ ID NO: 59119 - DNA, 580 bp, Homo sapiens
  misc_feature: GYAE6OF02GW3KZ.10.53.E09.1.454.CMB.1.raw
  modified_base (541)..(541): a, c, t, g, unknown or other
  misc_feature (541)..(541): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtggggtggcagttatctcattgatggagacaataaatactacagagactccgttcggggccgattcaccatctccaaaagacaatttgaaagaacacgctgtttctgcaaatgaaacagcctgagagctggaggacacggctgtgtaattactgttcgtttggtttctgacgttcggtacggggaagtaccttcgacgctacgtcggggccgacgggcacccgtcggtccgtacccgtcctcctccacgccctccacccgaacggccacgtccgtcccttccccgtcggccctaccctcccncccaacgaccgccaccctcggcggggcacgacgcccggg

SEQ ID NO: 59120 - DNA, 667 bp, Homo sapiens
  misc_feature: GYAE6OF02GDFQV.10.53.E09.1.454.CMB.1.raw
  modified_base (315)..(315): a, c, t, g, unknown or other
  misc_feature (315)..(315): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatgggagtttgggcgtgagctgggttttccgttccgttgtctcttttaagtaggtgtccagtgtcaggtggcagctggtggagtcgtgggggagggcgtggtccgacgccgtcgggagggtccctcgaggactctcctgtgcacgccgtcctggttccgtaccttctaatacctatggcntgcacgtcgggtccgccaggctccaggcgaagggcgtggaggtgggtggctcttatctcatatgagtaggtaaattagtttaaagttttatgctaacgtaccgttccgtagggaaaggggtcccgtacttacgacctatcctaccgaggaacgaactaaacttcccgacggaaactccccgtagttatccttacggaacgtaaaacttagaaacccgttacgacccgttaggaaggtaacgcctacggtaacccggaacgtacccgggttcgttttaaggtttttaacgtttaaccgtacggggtgttaaccccggaagtaaccgggaaggtaccctacggtcctttaacgg

SEQ ID NO: 59121 - DNA, 554 bp, Homo sapiens
  misc_feature: GYAE6OF02FGVGU.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctgggagtgggtggcagttatctcatttgatggagacaataaatactacagagactccgttcggggccattcaccatctccaaagacaattttgaagaacacgctgtttctgcaaatgaacagcctgagagctgaggacacggctgtgtattactgttcgtttggttctgtactcgtcggggaataccttcagcactggggccgagggcaccctggtcaccgtctcctcacgcctccaccacggcccacgtccggtccttcccccgtcggccaccctccctcccaacgacgccacccgtcgtcggggccacgacgtcccgg

SEQ ID NO: 59122 - DNA, 590 bp, Homo sapiens
  misc_feature: GYAE6OF02HIRYO.10.53.E09.1.454.CMB.1.raw
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactactagcttggtaccagcaagaaaccaggaacagcctacctaagctgctcattacnggcatctaccggatccggtcctgaccgtattcagtggacacggcgggtctggggacaggtactttcattctacacctatacancgacgtcctgcaggctagaagagtgacggntaagtttatacgttgtcagtctaacgttaacttaataccgttaacccctaagttaccctaaccgtacgttttcccgggaccccttacgggggtaaaaccctaaaagggttcgggtaacgtaaccgtaaaccgtaaaaccggtaaaccgttcgggtacggtacccg

SEQ ID NO: 59123 - DNA, 531 bp, Homo sapiens
  misc_feature: GYAE6OF02HB45H.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaagctgctcattactgggcatctaccgggaatccgggtccctgaccgattcagtggcagcgggtctgggacaggatttcgactctacaccatcagcagcctgcgaggctaggaagatgcggtctagtttattactgtcagtctactattactacgtacccattcactacgttccggacccttagggaacctaaaggtggaactacgtaccgaaaacgtaccgttaggtcggtaccg

SEQ ID NO: 59124 - DNA, 494 bp, Homo sapiens
  misc_feature: GYAE6OF02FWACV.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaaagctgctcatttactgggcatctaccgggaatccgggtccctgaccgattcagtggcagcgggtctgggacagatttcactctcaccatcagcagcctgcaggctgaagatgcggcagtttatactgtcagcactatatagtacccattcacattcggccctgggacccaagtggagatacaaacgactagtggtac

SEQ ID NO: 59125 - DNA, 551 bp, Homo sapiens
  misc_feature: GYAE6OF02IIDDS.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaaatactacagagactccgttcggggccgattcaccatctccaaagacaatttgaagaacacgctgtttctgcaaatgaacagcctgagagctgaggacacggctgtgtattactgttcgtttggtctgactcggtcggggaataccttcagcacgtgggccgagggccacccgtggtcaccgtctcctcacgcctccaccgaacggcccatccggtccttccccgtcggcctaccctccctcccaacgacgccacctcgtcggggcacgaggcccgg

SEQ ID NO: 59126 - DNA, 723 bp, Homo sapiens
  misc_feature: GYAE6OF02H5DKS.10.53.E09.1.454.CMB.1.raw
tcagcatagtagtgcacgaccggtgctcgatttagagagagtgtgttgggtttgggctgagcgtggtttctcgttagctctttaagaggtgtccagtgtcaggtgcagctggtggagtctgggggaggcgtggtccagcctggggaggtccctcagactctcctgtttagcctctggattcaccttcagttagttattcctttgcactggggtccgtcaggcctccgaggcaaggggctggaggtggggtggcagttatctctagtttgatggagacaataaatactacagagactccgttcggggcgtatcaccatcctaccaaagactaatttgaaagaacacgcttagtttcctgacaaagttgaaacacgcctagacgagtctagacggacgacggcttaggtgttatttacgttggtttcggttttggttcttggtacgttcgggtacgggggtaacttaccgttacgacggtcctaacgggttcggggaccgacgggtccctaacccggtcgggtaccctacccggttcccttaccctacgtaccggtaccccttacccgaaacccggaacccgggtacccctacggtttccccggttaccccgtttccccccggtccgggtcccctaaccccccttaccccgtaacccgaaccggtaccgtaccccgtacccggtcccgggttccggggggacccaccggacccgggtccccgggg

SEQ ID NO: 59127 - DNA, 529 bp, Homo sapiens
  misc_feature: GYAE6OF02IXB5P.10.53.E09.1.454.CMB.1.raw
tcagcatagtagtgcacgaccggtgctcgatttagagagagtgtgttgggtttggggagctacaacaggcaggcagggcagcaagatggtgttgcagacccaggtcttcatttctctgttgctctggatctctggtgcctacggggacatcgtgatgacccagtctccagactccctgcctgtgtctctgggcgagagggccaccagtcaactgcaaagtccagccagagtgttttatcagctccgacaataagaactacttagcttggtaccagcagaaaccaggacagcctcctaagctgctcattactggcatctaccgggaatccgggtcctgacgattcgagtggcagtggctgggacagacttcgactctcacatcagcagactaggacgctacgaagtaatttcgcgtagtgtaagttactagtcagcaagtatggtcgcccgcgctcgtaggtttacggcggtaggaccggtaaggttcgaaggtacgtacgaaaccgtaacgtacggtacggtcgtacgg

SEQ ID NO: 59128 - DNA, 566 bp, Homo sapiens
  misc_feature: GYAE6OF02G6M3A.10.53.E09.1.454.CMB.1.raw
  modified_base (341)..(341): a, c, t, g, unknown or other
  misc_feature (341)..(341): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttcngcaaatgaacagcctgagagctgaggacacggctgtgtattactgttcgtttggttctgtactcggtcggggaataccttcacgcacgtggggccagggccacccgtggtcgaccgtcctcctccacgccctccaaccgaacgggcccaacgtccggtccttcccccgtcggcccacccttccctaccaacgacgccgaccgtccgtcggggccacgacgcccgg

SEQ ID NO: 59129 - DNA, 562 bp, Homo sapiens
  misc_feature: GYAE6OF02GS85V.10.53.E09.1.454.CMB.1.raw
  modified_base (318)..(318): a, c, t, g, unknown or other
  misc_feature (318)..(318): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
tcagcatagtagtgcacgaccggtgctcgatttagagagagtgtgttggggtttggggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagcctccgacaataagaactacttagcttggtaccagcaagaaaccaggacagcctacctaagctgctcatttacnggcatcgaccggagtccgggtcctgaccgtattcagtggcaggcgggtcngggacagtactttcactctacaccatcagcacgcctgcgaggctaggaagngtcggacggtacttagtttaacttacgtgtcgtacgtactaacttattaactaaccgtaccctattacactacgttcccggacccgttacgggaacctaaaggtggaacgtacgtaaccgaaacggtacgttagtcggtaccg

SEQ ID NO: 59130 - DNA, 585 bp, Homo sapiens
  misc_feature: GYAE6OF02G88IO.10.53.E09.1.454.CMB.1.raw
  modified_base (329)..(329): a, c, t, g, unknown or other
  misc_feature (329)..(329): n is a, c, g, or t
  modified_base (471)..(471): a, c, t, g, unknown or other
  misc_feature (471)..(471): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctggggaggcgtggtccagcctgggaggtccctcagactctcctgtttagcctctggattcaccttcagtagttatcctttgcactgggtcctcaggctccaggcaaggggctggagtgggtggcagttatctctatttgatggagacaataaatactacagagactccggttcgggccattcaccatctaccaaagactaatttgaanaacacgcttgttctgacaaatcgaacagctgagagcgtagaggacacggctaggtgtattacgtgttcgtttggttctgtacgtcggtacggggaactacctacacgcgtacgtcgggaccgacgggcctaccgtcggtccnccgtctcctccacgtccctccgaaccgacggaccctacgtcccggtccttccccgtcggccctaccctcctacccgaagccgaccaccgtccgtacggggaccacgacgcccgg

SEQ ID NO: 59131 - DNA, 568 bp, Homo sapiens
  misc_feature: GYAE6OF02FOG2G.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaagggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaatacctcagcactggggccagggcaccctcggtcaccgtctcctcacgcctccaaccaacgggcccacgttccggtaccttccccgtcggtccctaccctccctacccaacgacgccaacccgtccgtcgggggtaccaccgacggtcccggg

SEQ ID NO: 59132 - DNA, 556 bp, Homo sapiens
  misc_feature: GYAE6OF02HPXVU.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctgggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgtttcgtttggttctgactcggtacggggaataccttcagctacgtggggccagggcacccgtggtcaccgtctcctcacgcctaccaccgaacggcccagtccgtccttccccgtcggccctacccctcctccaacgacgcaccctcgtcggggcaccgacgcccgg

SEQ ID NO: 59133 - DNA, 563 bp, Homo sapiens
  misc_feature: GYAE6OF02HYWAX.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagacgggccaccatcaactgcaagtccagccagagttgttttatcagctccgacaataagaactactagcttggtaccagcaagaaaccaggacagcctactaagctgctctatttactgggcactccgtacccgggaagtcccgggtcctagaccgtattcgagtggcaggtcggtcgtgggacagtctttacactctcaccactcagcacgcctgacaggctaggaacgatcgacggagttaagttttataccgttgtacgacgctaactttataacgtacgttaccctattacactacgtccggcccgttagggaaccctaaaggtggaacgtactaaccgaaacggtaacttcggtagtaccg

SEQ ID NO: 59134 - DNA, 570 bp, Homo sapiens
  misc_feature: GYAE6OF02GCOAL.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgactgtttctgcaaatgaacagcctgagagctgaggacacggctgtgtattactgttcgtttggttctgactcgtcggggaactaccttcagcacgtggggccagggcaccctggtcaccgtctccctcagccctccaccgaacggcccacgtccggttccttcccccgtcgggtccctaccccttccctacccgaacgacgcccaccgtccggtcgggggccacgacgtcccggg

SEQ ID NO: 59135 - DNA, 641 bp, Homo sapiens
  misc_feature: GYAE6OF02GYBI8.10.53.E09.1.454.CMB.1.raw
  modified_base (347)..(347): a, c, t, g, unknown or other
  misc_feature (347)..(347): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctgggagtgggtggcagttatctcatttgatggagacaataaatactacagagactccgttcggggccgattcaccatctaccaaagacaatttagaagaacacgactgtttcngacaaatgaacagcctagagagctgagacgacggctgtgtattactgtttcgtttgttcgtgtacgtcggtacggggtaactaccttacgagtcgtaacggtcggggaccgacgggcctacccgtcggttccgaacccgttccgtcccgtaccgaccgtaccccttacccgaacccgtaaccgggccccgtacgttcccggttcccgttacccccgtcgggtcccctaccccgttccctacccgaacgaccgaccctacccgtccggtccggggaccaccggacggtccccggg

SEQ ID NO: 59136 - DNA, 545 bp, Homo sapiens
  misc_feature: GYAE6OF02IQC6T.10.53.E09.1.454.CMB.1.raw
  modified_base (314)..(314): a, c, t, g, unknown or other
  misc_feature (314)..(314): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagacgggccaccatcaactgcaagtccagccagagtgttttatcagctccgaacaataacgaactactagcttggtaccagcaagaaaccaggacagcctccaagctgctcatttacnggcatcctaccgggactcccgggtcctgaccgattcagtggcaggcgggtctagggacagtatttccactcctcaccatcagcacgcctgcaggtctagaacgtagtgccggctaagtttatacgtgtcagtctaactattactacgtaccctattccgaactacgttccggacccgtagggaaccctaaagggtcgaagtacgtaaccaacggtaactggtacggtaccg

SEQ ID NO: 59137 - DNA, 622 bp, Homo sapiens
  misc_feature: GYAE6OF02GCZU1.10.53.E09.1.454.CMB.1.raw
  modified_base (331)..(331): a, c, t, g, unknown or other
  misc_feature (331)..(331): n is a, c, g, or t
tcagcatagtagtgcacgaccggtgctcgatttagagagagtgtgttgggttttcctcgttgctcttttaagaggtgtccagtgtcaggtgcagctggtggagtctggggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcggggccgattcaccatctaccaaagacaatttgaaagaacacgctgtttcngacaaatgaacagcctgagagctgaggacacggctgtgtattacgttgtttcgtttggttctagtacgtcgggtacggggtaattaccgttacacgcgtacgtcggggaccgacgggcctaccgttcggtacctacccgttcctcctcacgtccctacccgaccgaacgggcccctagtcccggttcccttcccccgtggtccctaccccgtccctaccgaacgaccgaccctacccgtcggtccggggaccaccggacggcccggcccggtgggccgtcggccgtacggg

SEQ ID NO: 59138 - DNA, 563 bp, Homo sapiens
  misc_feature: GYAE6OF02F3DM6.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccattcaccatctaccaaaagacaatttgaaagaacacgctgtttctgacaaaatgaaacagcctgagagctgaggacacggctgtgtattactgtttcgtttggttctgtactcggtcggggaacttaccgttcagcgacgtggggccgagggcacccgtggtccaccgtctccgtcacgcctccaaccaacggcccagtccggtcctccccgtggcccaccctcctaccacgacgccaccgtcggcggggccacgacgcccgg

SEQ ID NO: 59139 - DNA, 499 bp, Homo sapiens
  misc_feature: GYAE6OF02FUF2Q.10.53.E09.1.454.CMB.1.raw
  modified_base (342)..(342): a, c, t, g, unknown or other
  misc_feature (342)..(342): n is a, c, g, or t
  modified_base (399)..(399): a, c, t, g, unknown or other
  misc_feature (399)..(399): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgaccccagtctccagactccctgcctgtgtctctgggcgagagggccaccatcaactgcaagtccagccagagtgttttattcagctccgacataagaactcttatcttggtaccagcagaaaccaggacagcctctaagctgctcattactggcatctaccgggaatccgggtccctgaccgnttcagtggcagcgggtctgggacagatttcactctcaccatcagcagcctgcaggcngaagatgcggcagtttatactgtcagctactattaactacgtaccccattcactattccggccctgggaccaagtggagactaccaacggacttgtgtcg

SEQ ID NO: 59140 - DNA, 593 bp, Homo sapiens
  misc_feature: GYAE6OF02JBVDB.10.53.E09.1.454.CMB.1.raw
  modified_base (343)..(343): a, c, t, g, unknown or other
  misc_feature (343)..(343): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtggggtggcagttatctcatttgatggagacaataaatactacagagactccgttcggggccattcaccatctccaaagacaatttgaagaacacgcttgttcngacaaatgaacagcctgagagctgaggacacggctgtgtattactgttcgtttggttctgtacgtcggtcggggtaacgtaccgttacgacgcgacgtcgggccgacgggccgacccgtcggtccgtaccgtcctcctccacgcctcccgccgaaaaaaacggcccgacgtccggtcccgttccccgtccggccctacccctccctacccaacgacgaccgaccgtccgtcgggccgaccgacgtcccgg

SEQ ID NO: 59141 - DNA, 547 bp, Homo sapiens
  misc_feature: GYAE6OF02H9CDI.10.53.E09.1.454.CMB.1.raw
  modified_base (418)..(418): a, c, t, g, unknown or other
  misc_feature (418)..(418): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcaagaaaccaggacagcctacctaagctgctctatttactggcatcgtaccgggacgtccgggtccctgaccgtattcagtggcaggcggtcgtgggacagtactttcacttctcaccatcagcagcctgcaggctagaagntgcgtactagttttatacgtgtacacgctaattattactaaccgtaccctattaccacgtacgttccggacccgtagggaacctaaggtggaacgtaactaaccgaaaacggtactcgggtaggtaccg

SEQ ID NO: 59142 - DNA, 522 bp, Homo sapiens
  misc_feature: GYAE6OF02HIFC9.10.53.E09.1.454.CMB.1.raw
  modified_base (295)..(295): a, c, t, g, unknown or other
  misc_feature (295)..(295): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactactagcttgtaccagcagaaccagacagcctccaanctgctacattactggcatcgtaccggatcccgggtccctgaccgtattcgagtgcagcgggtctgggacagtactttcactctcaccactcagcacgcctgcaggctgaagntgcgntagtttatactgtcagtctactattatacgtaccctatacactacgttccggacccgttagggaaccctaaggtcggaacgtaacgtaccgaaagtacgtggtacgtacg

SEQ ID NO: 59143 - DNA, 554 bp, Homo sapiens
  misc_feature: GYAE6OF02JBR5S.10.53.E09.1.454.CMB.1.raw
  modified_base (502)..(502): a, c, t, g, unknown or other
  misc_feature (502)..(502): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtggggtggcagttatctcatttgatggagacaataaatactacagagactccgttcggggccgattcaccatctccaaagacaatttgaagaacacgctgtttctgacaaatgaacagcctgagagctgaggacacggctgtgtattactgttcgtttgttctgactcggtcggggtaataccttcagcgtacgtgggccgagggcacccgtggtccacgtcctcctcgcgcctccaccacggcccagtccgtccttccccgngccctaccctcctacccaagacgccaccgtcgtcggggccacgacggcccgg

SEQ ID NO: 59144 - DNA, 623 bp, Homo sapiens
  misc_feature: GYAE6OF02I78R3.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctcgtgggcgaggacgggccaccatcaactgcaagtccagccagtagttgttttatcagtcctaccgacaaataagaaccttacttagcttaggtaccagcaacgaaaccaggacagcctacctaagctgctacatttacgtgggcactccgtaacccggggaactccccggggtccctacgaaccgtacttcgagtcgggcacggtcgggtctggggactaggtactttcactcctcaccatacagcagcctagcgacggtctaggaagatcggacggctttaagttttacttaccgtagtaccagtacctaacttattaacgttaaccgtaacccctattaccgtactaccgttccgacccggttaagggaaccctaagggtacggtaacgtaacgtaacctaaaacggtaaccttcgggtacggtactacgtaacccg

SEQ ID NO: 59145 - DNA, 625 bp, Homo sapiens
  misc_feature: GYAE6OF02I7Q83.10.53.E09.1.454.CMB.1.raw
  modified_base (329)..(329): a, c, t, g, unknown or other
  misc_feature (329)..(329): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttggggacaacaggcaggcgaggggcagcaagatggtgttgcagacccaggtcttcatttctctgttgctctggatctctggtgccgtacggggacatcgtgatgacccagtctcagactccctgcctgtgtctcgtgggcgaggacgggccaccatacaactgacaacgtccagccagtagttgttttactcagcctaccgaacaataagaacttacttagtcttaggtaccagctaagaaaccgagacacgtcctactagctcgctctatttacgnggcagtccgtaccgggacgtccgggtcctgaccgtattcgnggtggcgaggtcgggtctggggaacaggttacttccgacgtcctacaccgtactcgagcacgtcctagacgaggtactaggaacgtgtcggaccggtacgttagtttacttacgtagtccgacgtacttaattaacttaccgttaaccgtaccccttaatccctaacgtccgttaccgggacccgttacgggtaaacccgtaaagggtcggaacgtaataacccggaaacgtccgtacggtcggtcctagtcccg

SEQ ID NO: 59146 - DNA, 530 bp, Homo sapiens
  misc_feature: GYAE6OF02FULNO.10.53.E09.1.454.CMB.1.raw
  modified_base (313)..(313): a, c, t, g, unknown or other
  misc_feature (313)..(313): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttggtaccagcagaaaccaggacagcctcctaagctgctcatttacngggcatcgtacccgggaatcccgggtccctgaccgattcagtcggcgagtcgggtctgggacagactttcactctcaccntcagcagcctgcgaggctagaagngtgcggtctagtttattactgtcagctatattatacgtaccctattcaactcgttccggaccgtacggaacctaaggtaggagtacgtaaccaaacggacgtaggtgtacccg

SEQ ID NO: 59147 - DNA, 670 bp, Homo sapiens
  misc_feature: GYAE6OF02GWM75.10.53.E09.1.454.CMB.1.raw
  modified_base (266)..(266): a, c, t, g, unknown or other
  misc_feature (266)..(266): n is a, c, g, or t
  modified_base (490)..(490): a, c, t, g, unknown or other
  misc_feature (490)..(490): n is a, c, g, or t
tcagcatagtagtgcacgaccggtgctcgatttagagagagtgtgttgggtttgggcgtgagctgggtttcctcgttgctctttaagaggtgtccagtgtcaggtgcagctggtggagtctgggggaggcgtgggtccagcctgggaggtccctcagactctcctgtttagcctctggattcacttcagtagttatcctttgctacgtgggtcctcgaggctccgaggcaagggggctgggaggtggggtgctaaggttatccgtntatttgattggagactaataaatactacagagtaactccggttcggggaccgtattcgaccatcctacctaaaagcctaaatttagaagaaccacgccgttagtttccagactaaaatcgaaacacgtaccgtagagagtacgtaggaacggacaacgggcttaggtacgtatttaccgtgtttacgtttggtctaggtccttacgggtcgggtaactaccgtntaacggctacggtcgggcgtacgggcctacccgtggtacccgtacgtaccgttcctactacgtaccctccgaaccgaccgggaccctacggtccgttccctccccgtcggtccctacccctacccgtacccgaacgtaccgcccgtaaccgtccggcgggtaccacggaccggtcccggg

SEQ ID NO: 59148 - DNA, 588 bp, Homo sapiens
  misc_feature: GYAE6OF02GOYRI.10.53.E09.1.454.CMB.1.raw
tcagcatagtagtgcacgaccggtgctcgatttagagagagtgtgttgggttttcctcgttgctcttttaagaggtgtccagtgtcaggtgcagctggtggagtctggggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaaccacgctgtttctgcaaaatgaacagcctgagagctgaggacacggctgtgtattactgttcgtttggttctgaccgttcggtcggggtaataccgttcagctacgtcggggccagggccaccgtgtccaccgtctcctcgacgcctccgaccgaacgggccctacgtccggtccttccccgtcggaccctaccccgtcctaccgaacgacgcctaccgtccgtcggggccaccgacggtccggtccccgtgggtcctcggcccgttacggg

SEQ ID NO: 59149 - DNA, 583 bp, Homo sapiens
  misc_feature: GYAE6OF02G478M.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactcgtcgggccgattcaccatctaccaaagacaatttgaagaacacgctgtttctgacaaatgaacagcctgagagctagacggacacggctggtgtattactgttcgtttggtctgtactcggtcggggaactaccgttcagcacgtcgggccgaggctacccgtggtccaccggtctccgtcacgtccctacccgaccgaacggccctacgtcccggttccttcccccgtcggcccaccccttcctacccgaacgacgtcccaccgtccgtcggggaccaccgacggtccccggg

SEQ ID NO: 59150 - DNA, 627 bp, Homo sapiens
  misc_feature: GYAE6OF02FODTR.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctaccaaagacaatttgaaagaacacggtactgtttactgactaaaatgaaacacgcctgagagctagagacacggctagtgtattacgtgttcgtttggttctgtacgtcggtacggggtaatacctcgacgcgacgtcggggccgagggcctacccgtcggtcgacccgttctcccgtcaccgtccctaccaaccgaacgggccctagtcccggttacccttcccccggtacggtcccctaccccttacccgtaccctaacgtaccggaccctacccggttccggtacggggggacccacgtacggtaccccggg

SEQ ID NO: 59151 - DNA, 638 bp, Homo sapiens
  misc_feature: GYAE6OF02GQE8X.10.53.E09.1.454.CMB.1.raw
  modified_base (327)..(327): a, c, t, g, unknown or other
  misc_feature (327)..(327): n is a, c, g, or t
  modified_base (487)..(487): a, c, t, g, unknown or other
  misc_feature (487)..(487): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagaggccacatcaactgcaagtccagccagagttgttttactcagcctaccgacaataagaactacttagcttaggaccagaccaagaaaccaggacacgtccctacctaaagctgcctactaatttacgnggacctacgtaccgtaaccccggggaacgttccccggggtccctacggaacccgtattaccgaggtcggcgacgggtccgggtacgtacgggacagtactttccgaacctccgtaccaaccatccgaacgtcgacgtcctcgaccgtaggctagaaaggntccgggaccgtacgttaacggtttaattaccgtgtaccgagtactaacttacgtactaaccgtacccctattccacgtacgtcccggacccgtacgggtaaccgtaaaggtcggaacgtactaaccgtaaaccgtacgttcggtagtaccg

SEQ ID NO: 59152 - DNA, 711 bp, Homo sapiens
  misc_feature: GYAE6OF02IBEQB.10.53.E09.1.454.CMB.1.raw
  modified_base (251)..(251): a, c, t, g, unknown or other
  misc_feature (251)..(251): n is a, c, g, or t
tcagcatagtagtgcacgaccggtgctcgatttagagagagtgtgttggggtttggggctctgggagacgagcccagcactggaagtcgccggtgtttccattcggtgatcatcactgaacacagaggactcaccatggagtttgggctgagcttgggttttcctcgttgcttctttttaagaggtgtccagtgtcaggtgcagctggtggagtcgtgggggagcgtggtccagccgtgggacggtccctnacgactcctcttgtttacgcctcgtggattcaccttcagttagttatcctttgcctacgtcgggtccgtcacggctccgaggcgaaggggctgggaggtggggtggctaggttactcttactagttttgaagtgggaacaaactaaaagtaaaaactactaacgaaggtacggtaaccgttccgggtttaccgggggaccgtacttcaaccctagttaccctaaccaaaagtaactaaagtttacgaaaggtaaacctaacgtacgtttcgttttacgtacgaaccgtaaagtacgaaaccacgtaccgtaggaacgtacggaccgttaaggacgggtaaccgacggtcgttagtacggttaactttacgtttcggttttcggttttcgggttaccttaggttaccgttcggggtaacggggttaaccttacccggtttacgtacggtccgtaaccgggg

SEQ ID NO: 59153 - DNA, 650 bp, Homo sapiens
  misc_feature: GYAE6OF02G4VFO.10.53.E09.1.454.CMB.1.raw
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagaatccgttcgggccgattcaccatcctaccaaagacaatttgaaagaacacgcttgtttcagacaanacaacacgctagaagacncgtaggacgacgacgtcgtgtagttacttacgttcggtttcggtttgttcgtacgtacggttcgggtaacgggtacttaccgttacgacgacgtacggtcgggaccggacgggacccgtaccgtcgtacccgtaccgttccctccgtaccgacccgcccgtacccgaacggacccggacccgttacgttcccgttcccgttccccgtccggaccctacccctaccctaaccgaacgacgacccgtaccgtccgggaccgggacaccggccggtccccggg

SEQ ID NO: 59154 - DNA, 574 bp, Homo sapiens
  misc_feature: GYAE6OF02IIV5U.10.53.E09.1.454.CMB.1.raw
  modified_base (304)..(304): a, c, t, g, unknown or other
  misc_feature (304)..(304): n is a, c, g, or t
  modified_base (368)..(368): a, c, t, g, unknown or other
  misc_feature (368)..(368): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctggcgagaggccaccatcaactgcaagtccagccagagtgttttatcagctcgacaataagaactacttagcttggtaccagcagaaaccaggacagcctcctaagctgctcatttacnggcatccgtaaccggaatccgggtcctgaccgattcagtgcaggcggtctagggacagatttcncttactacacctatcagcagcctgcaggtctacgaagagtggccgtactaggttttacttacgttgtacacgtactaacttaattaagttaacgtacccctagttaccaactacgttccgggacccgtagggtaaaccctaaaggttggaacgtaagttaacccgaaaacggttaaccctagggtacggtaccgtacggtaacccg

SEQ ID NO: 59155 - DNA, 616 bp, Homo sapiens
  misc_feature: GYAE6OF02I8MLU.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtcctcaggctccaggcaaggggctggagtgggtgcagttatctcatttgatggagacaataaatactacagagactccggttcgggcattcacatctacaaagactaattagaacaacacgcttgttctagacaaatgaaacacgcctgagagctaggacggacacggctagtagttattacgttcgtttcggttttaggttcgtacggtacgttcgggttacgggggtaacttaccgttacgaggtccgtacggtcggggaccgacgggcctacccgtcggtccgtaccgtcctccgtcacgtccctacccaaccgaccggacctacgtcccgttcccttcccgtacggccctaccccgtccaaccgacgacgcctaccgtcgtcggggaccacgccggtcccgg

SEQ ID NO: 59156 - DNA, 568 bp, Homo sapiens
  misc_feature: GYAE6OF02I29F8.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcgagtggcaggcggtctggacgagtactttcacgtctcacccatacacgcacgcctcgcgagcgtgaagagtacgcggtactagtttattacgttgtcgtacgactactattacttacgtacccctattacctactacgtttccggtcccgtacgggaacccgtaaaggtcggaacggtacgtaccaaaccggtaaccttaggtacggttaccgtcgtaacccg

SEQ ID NO: 59157 - DNA, 603 bp, Homo sapiens
  misc_feature: GYAE6OF02GV6RD.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgaacaataaagaactacttagcttggtaccagcaagaaaccaggacagcctacctaagctcgctctatttacgtgggctactaccgtacccgggaacgttcccggggtccctacgaccgtattcgagtggcaggcggtctagggacagtacttcactctccacctatcgagcacgcctcgcgacggactaggaagagtcggaccgtacttaagttttactacgttggtaccacgtactaacgttaattaacgttaccgtaaccccttattaccacgttaccgttcccggtacccggtacgggaaccgtaacggtggaacgtacgtaacgaaacggtaccgttaggtcggtaccgtacgtacc

SEQ ID NO: 59158 - DNA, 513 bp, Homo sapiens
  misc_feature: GYAE6OF02HN19X.10.53.E09.1.454.CMB.1.raw
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactacttagcttggtaccagcagaaaccaggacagcctcctaagctgctcatttactggcatctacccgggaatccgggtccctgaccgattcagtggcaggcggtcgtgggacagtattcactctcaccntcagcagcctgcaggctgaagntgcgactagtttactacttgtcagcattatatacgtaccctnttacactagtcgcccgtaggaacctaaagtcggagtactaccgtaaacgtaactgtaggtaccg

SEQ ID NO: 59159 - DNA, 743 bp, Homo sapiens
  misc_feature: GYAE6OF02JD1F7.10.53.E09.1.454.CMB.1.raw
  modified_base (247)..(247): a, c, t, g, unknown or other
  misc_feature (247)..(247): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggaggtccctnagactctcctgttacgcctctggacttcacctttcagttagttactcctttgcctacgtgggtcccgtcacggcctccgaggcgaaggggctgggagtggggtgctagttatctctagtttgagtggaagtaactaaaagtaaatactaacgaagtaacggtaccgtttacccgggttacggggacccgtacgtttacccaaccgtacgttaccctaacccgaaaacgtaactaaagtttacgaaacggtaaacctaacgttaccgtttagtttaccgtacgtaacgtaaatacgaaaccgtacgtacccgtaggtaacggacgtaccgttagggaacgggtaacccgaaccgggtacttagggttacgtttaacgtttacggtttcggttttaccggtttttcgggtttaccgtttacggttaaccgggttaccggggtttaaccgggggtaaccttttaacccggttacggtaccggtaccggttaacccgggg

SEQ ID NO: 59160 - DNA, 556 bp, Homo sapiens
  misc_feature: GYAE6OF02F6YKM.10.53.E09.1.454.CMB.1.raw
  modified_base (244)..(244): a, c, t, g, unknown or other
  misc_feature (244)..(244): n is a, c, g, or t
  modified_base (348)..(348): a, c, t, g, unknown or other
  misc_feature (348)..(348): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggagtccctnagactctcctgtttagcctctggattcacctttcagtagttatcctttgcactgggtccgtcaggcctccgaggcaaggggctgggagtgggtgcagttatctntattgatggagacaataaatactacagagactccggtcgggaccgtattcaccactctaccaaagactaattagaagaacacgtctcgtttctgacaatagaacagacctagagagcgtagaacgacgacggctaggtgttattacgtgtttcgtttcggttcttagtacgttcggtacggggtacttaccgtcgacgtcgtaccggg

SEQ ID NO: 59161 - DNA, 737 bp, Homo sapiens
  misc_feature: GYAE6OF02H00CP.10.53.E09.1.454.CMB.1.raw
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtcctccagacctccctgcctgtgtctcgtgggcgagacgggccaccatccaactgcaacggtccacgccagagttgttttactcagcctaccgactaaataacgaacttacttagcttacggaccagacaaagaaacccnggaaccacgccctacgtagctgctactatttacgngggactacgtccgtaaccgggacgttccccgggtaccctggaccgtattccgtaggttcggacgtacggcgggtttacgtacggggaacctagggttacttttccgaaccttcccgtaccctaccgtactccgaagccgtacgtcccgtcgaccggacggtcgtaaggtaaacgacgttcgggaccggtacgtttaacgttttacgttaccgtacgttaccgaacggtaccttaacgttttaacttacgttaaccccgttaacccttacttaccgtaaccgttaccggttacccgggttaccccggttaacggggtaacccgttaaaagggttaccgggaaacggttaacccggtaaaccggtaaaacccgggtacgttcgggtaccggtaacccgg

SEQ ID NO: 59162 - DNA, 541 bp, Homo sapiens
  misc_feature: GYAE6OF02G73SV.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgaggacacggctgtgtatactgttcgtttggttctgactcgtcggggaataccttcagcacgtgggcagggcaccctggtcaccgtctcctcagccgtccaccgaaaggcccaatccggtccttcccctcggtccacccctcctccaacgagcacctcgtggggccacgtagcccgg

SEQ ID NO: 59163 - DNA, 736 bp, Homo sapiens
  misc_feature: GYAE6OF02HNKHZ.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggctagttatctcatttgatggagacaaataaatactacagagacctccggttcggggccgtattccaccatcctaccaaagactaatttcgaaagaacacgcttgtttctagacaaaatgaaccagtcctagagagcgtaggaacggaccgacggtcttggttagttaactttacgttggttttccgttttggttaccgttaggtaccgttcgggttacgggggtaaactttacccgttacgacggtaccgtaacgggttcgggggacccgtacggggtaccctacccggtcgggtcccacccggttccttcccgtaccaccggtcccgttacccgaacccggtaacccgggccctaacggttcccggttaccccttcccccggtacccgggtacccctacccccgttaccccgtaacccgtaaccggtacccgtacccgtacccggttccgggttaccgggggaccctacccgggtaccggtccccgggg

SEQ ID NO: 59164 - DNA, 634 bp, Homo sapiens
  misc_feature: GYAE6OF02JJRGE.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagatttgttttattcagctccgaacaataagaactactagcttaggtaccagcaagaaaccaggacagcctacctaagctgctctattacgtggacactaccgtacccgggaacgtcccgggtccctacgaccgtattccgaaggtcggcaggtccgggtacgtacgggactacgtactttcactcctacaccatcagtcagtaccctgacctaggcttaggaaacgtgtcggccggtacttaagttttacgttaccgttggtacctacgtactaactttaacgttaactaaccggttaccctaatttaccgaacgttaccggttcccgggacccgttacggggaaaaccccgtaaaggtcgggtaacgtacgttaacccgaaaacggtacgttcggtaccggtaccg

SEQ ID NO: 59165 - DNA, 694 bp, Homo sapiens
  misc_feature: GYAE6OF02HWUZY.10.53.E09.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
tcagcatagtagtgcacgaccggtgctcgatttagagagagtgtgttgggttttcctcgttgctcttttaagaggtgtccagtgtcaggtgcagctggtggagtctggggggaggcgtggtccagcctgggaggtccctcagactctcctgtttagcctctggattcaccttcagtagttatcctttgcactgggtccgtcaggctccaggcaaggggctggagtgggtggcagttatctcatttgntgganacaataaatactanagagactccgttcgggccgattcaccatctaccaaagacaattgaagaacacgcttgttctgacaaatgaacagcctagagagcgtagacggacgacggtctgtgtaattacttgtttcggtttggttctgtacgttggggttacggggaacttaaccgttcgacggtcgtaccggtcggggaccgtacggggaccctaacccggttcgggttacccacccggttccgttccctaccgtaccggtccccttacccggaacccgaacggggtcccctaacggttccccggttacccccttttccccccggtcggtacccctacccccgttcccgtacccgaacggaacccggtcctacccgttccgggtcgggggtacccaccggacggcccgggtcccggtacggggcccgtccggtacccggttcgg

SEQ ID NO: 59166 - DNA, 586 bp, Homo sapiens
  misc_feature: GYAE6OF02HPMOR.10.53.E09.1.454.CMB.1.raw
  modified_base (180)..(180): a, c, t, g, unknown or other
  misc_feature (180)..(180): n is a, c, g, or t
  modified_base (374)..(374): a, c, t, g, unknown or other
  misc_feature (374)..(374): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggagtcgtgggggagcgtggtccagcctggggacgtccctcagctctcctgtttagcctctggattcaccttcagttagttactccttttgcctacttggggtcccgtcgaggcctccgaggcaaggggctgggaggtgggtgctagttatctctagtttgattgganaacaaagtaaatacaacagagtactccgggttcgggcctattccacatctaccaaagacaattgaaagaactacgtcttcgttctagactaaatgaacacgctagacgagcgtagacggacacggtcgtagtagttaactttacgttggtttacggttttggtcgttagtacggttcgggtacgggtaacttaccgttcgacgtcgtaccgg

SEQ ID NO: 59167 - DNA, 603 bp, Homo sapiens
  misc_feature: GYAE6OF02HECGR.10.53.E09.1.454.CMB.1.raw
  modified_base (181)..(181): a, c, t, g, unknown or other
  misc_feature (181)..(181): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
tcagcatagtagtgcacgaccggtgctcgatttagagagagtgtgttgggtttggggggctctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggagtcgtgggggagcgtggtccagccgtggggacggtccctnagactctccttgtttagccttntggtattccacctttcagttagttactcctttgcctacgtcggggtcctcgacggcctaccgagggcgaaggggctgggaggtggggtcggctagttatctctattgatgganaacaaataaatactaanagacgccgttccgggtcgggcctactccacctatacctacaaagactaagttacgaaagacacgtcttgttctagacaaatcgaacagtcctagagagcgtaggacggacgacggtctggtacgttagttacgttgtttcggtttgtcgttacggtacgttcggggttacgggtaacttaccgttacgacgtcgtaacggg

SEQ ID NO: 59168 - DNA, 572 bp, Homo sapiens
  misc_feature: GYAE6OF02FIY9L.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtgtctctgggcgagagggccaccatcaactgcaagtccagccagagttgttttatcagctccgacaataagaactacttagcttggtacccagcagaaaccaggacagcctctaagctgctcatttacgtggactataccgtacccgggaatcccgggtaccctgaccgattcagtggcacgtcgggtctggggacaggtactttcgacttctacaccatcacgacacgtcctagcgaggactaggaacgagtcgcggtactaggttttaactacgtgtacagtctaacgtattactacgtacccctattccaactcgttccggaccgtacgggtaacccaaaggtcggaacgacgtaaccgtaaacggacttaggtacggtaccg

SEQ ID NO: 59169 - DNA, 818 bp, Homo sapiens
  misc_feature: GYAE6OF02IER87.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacgggacatcgtgatcgacccagtctccagtacctccctgcctgtcgtctcgtgggacgagacgggccaccatcaactcgcaacgtccacgaccagtacgttagttttactcacgccttaccgaacaaataacgtaaccttaacgtttacgtccgtttacgggtaacccaggtaaccaacggtaaaaacccgaggggaaaccctaccggtaccccgttaacccgtaaacggtcctttaccggacctttacttaaaccggtttttaccggacggggtacctacgttacccggtaaccccggggtaacgttccccggggtaccccgtagtaacccggtacgttaccgtaaggtcgggaccaacgggtccggggtaccggtcggggaactacggtttctttacctaccgttccctacctaaccggtataccgaacggtccgtacggaccttcgggaaccgtacgggtacgtacgggaacgtagtaccggcggtaaccgttagttttaacgttacgttacgtaccgtaacgtaacttactttaaagttaaccgttaaccgttaccccgttacttaccgaactttaccggttacccgggtaccccggttaacgggtaaaccggtaaacggtacggtaacgaacgtttaaccgaaaccgggttaacttcgggagttacccg

SEQ ID NO: 59170 - DNA, 607 bp, Homo sapiens
  misc_feature: GYAE6OF02GG3I1.10.53.E09.1.454.CMB.1.raw
  modified_base (157)..(157): a, c, t, g, unknown or other
  misc_feature (157)..(157): n is a, c, g, or t
  modified_base (282)..(282): a, c, t, g, unknown or other
  misc_feature (282)..(282): n is a, c, g, or t
tcagcatagtagtgcacgaccggtgctcgatttagagagagtgtggttggggtttgggctgagctgggttttcctcgttgctcttttaagaggtcgtccagtgtcaggtgcagctggtggagtctgggggagcgtggtccagcctgggaggtccctnagactctcctgtttagcctctggattccaccttcagtagttatcctttgcactgggtcctcaggctccagggcaaggggctgggagtggggtggcagttatctcatttgatggaagacaataaanactacagagactccgttcggggccattcaccagtctccaagtacaagttagtaagaacaacgcgtcgtttcgttgcaaatacgaacgacgctcggagagactgaacggacgacggacgtgtgtattacgttagtttcgttttcggttcgtgtacgtcggtacgggggtaacgttaccttacgtagtcgtacgtggggtccgacgggccgacccgttacggtactacccggtcctccgtctacgaccttccgaccaacgggccacgtcgtccgtcccctcggcaccctccgtaccacgacgcacctcggtcgggcacgagtcccgg

SEQ ID NO: 59171 - DNA, 543 bp, Homo sapiens
  misc_feature: GYAE6OF02HCO2X.10.53.E09.1.454.CMB.1.raw
  modified_base (468)..(468): a, c, t, g, unknown or other
  misc_feature (468)..(468): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttggtaccagcagaaaccagacagcctcctaagctgctctatttactggcatccgtacccgggtaagtcccggggtccctcggacccgatttcgagtggcacggcgggtctgggacagtactttcactctcaccatcagcagcctgcaggctagaagatcggcggactagtttatacgtgtacagtctattattactacgtaccctnttccactacgttccggccgtacgggaacctaaggtgacgaacgtacaaacggtacttaggtccggtacgtgtacc

SEQ ID NO: 59172 - DNA, 496 bp, Homo sapiens
  misc_feature: GYAE6OF02IPT54.10.53.E09.1.454.CMB.1.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactcctgcctgtgtctctgggcgagagggccaccatcaactgcaagtccagccagagttgttttattcagctccganaataagaactacttagcttggtaccngnagaaaccaggacagcctactaagctgctcattactggcactctacccgggatccgggtcctgacgatcngtgcagcggtctgggacagatttcactcacaccatcancacgtcctgcgaggctagaagagcgacgtctagtttatactgtacagcactattactactaccctattccatcttccgccgtggaaccaaggtgagatacaacgactgcgtcagacc

SEQ ID NO: 59173 - DNA, 769 bp, Homo sapiens
  misc_feature: GYAE6OF02II9BY.10.53.E09.1.454.CMB.1.raw
  modified_base (371)..(371): a, c, t, g, unknown or other
  misc_feature (371)..(371): n is a, c, g, or t
tcagcatagtagtgcacgaccggtgctcgatttagagagagtgtgttgggtttgggggagctacaacaggcaggcaggggcagcaagatggtgttgcagacccaggtcttcattttctctgttgctctggatctctggtgcctacggggacatcgtgatgacccagtcctccagacctccctgcctgtgtctcgtgggcgaggacggccacatccaactgacaacgtccacgccgtagtagtttgttttactcgagtcctaccgaacaaataaacgtaaccttacttagtcttacggtaccagaccaaacgaaaaccgaggaaccacggtacccttaaccgtaagtcctcgaccttactaattttaccggngggtacctacgtacccggtaaaccccgggaacgttccccgggtaccctaggtaacccgtacgttaccgaaggtcggaccgtaggggtccgggtaacgtaggggtaacctaacggtttacctttacctaccgttccctaaccgaacccgtaacgtaccgacgtaccgaccgtccgttacggacggtaacggtacgtaggaaacgtacgttcgggaccggtaactttacggtttaacttacgtcgtacacgttacctaaacgtttaacttaaccgtaacccgttaaccctacttaccgaaccgttaccggttcccggtaaccccgggtaacgggaaacccttaagggtagggtaacgaaccgttaaaccggaaaccgtttaacggttcggtaccgtaccg

SEQ ID NO: 59174 - DNA, 643 bp, Homo sapiens
  misc_feature: GYAE6OF02IK7BY.10.53.E09.1.454.CMB.1.raw
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (500)..(500): a, c, t, g, unknown or other
  misc_feature (500)..(500): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctggattcaccttcagtagttatcctttgcactgggtccgtcaggctccaggcaaggggctggaggtggggtggctagttactctcatttgatggagacaataaatactaanagagactccggttcgggccgattcaccatctaccaaagacaatttagaanaacacgcttgtttctcacaaatgaaacagcctagagacgctagaggacacggctaggtnttattacgttgtttcggttttcgttntcgtacgttcgggtacggggtaacttacccgttcgacgccgtacggtcggggaccgacgggccgtacccgtcggtccncccgttcctcccgtaccactccctacccgaacccgaacgggtaccccacgttcccggtcccttcccccgtcggacccctaccccttccctaccccgaagaaccgccctaccgttccggcggggtaccaccggcgtccccgggg

SEQ ID NO: 59175 - DNA, 722 bp, Homo sapiens
  misc_feature: GYAE6OF02GSU7M.10.53.E09.1.454.CMB.1.raw
  modified_base (182)..(182): a, c, t, g, unknown or other
  misc_feature (182)..(182): n is a, c, g, or t
  modified_base (255)..(255): a, c, t, g, unknown or other
  misc_feature (255)..(255): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
tcagcatagtagtgcacgaccggtgctcgatttagagagagtgtgttgggtttggggcgtcgtgggagacgagcccagcacttgaagtcgccggtgtttccattcggtgatcatcactgaacacagaggactcaccatggagtttgggctgagctgggttttcctcgttgcttactttaagnggttgtccagtgtcaggtgcagctgggtggagtcgtgggggacggcgtggtccagcccgtggggacgtccctnagtacctcttccgtgttttacgcctcgtggacttccgacctttcaagttagttacttccgtttgctacgtgggttccgactacggcctccgaggtccgaaggggtctgggagttgggcggtctagtttaacnctctagttttgattgggaanacctaaaagtaaactacctaaacgaggtagtacccgtttacccgggttcgggacccggtattaccgtacctacgtacccgtaacccgtaaaacgtaaccttaaacgtttaacggaaacgtaaacccgtaccgttaacgtttaccgtttcgtaaccgtaacgaaacgttaacgaaacgtacgaccgtagaacgacgtacgtagaacggaccgtaacggtcgttacgttagttacgttacgttcgtttacggtttcggttccgttagtccgtacgggttaccgggtaaacttaccggttagtaccgacctaccgggg

SEQ ID NO: 59176 - DNA, 750 bp, Homo sapiens
  misc_feature: GYAE6OF02J2Y4X.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtcctcaggctccaggcaaggggctgggagtggggtgcagttatcgtcatttgatggagacaataaatactacagacgactccgtcggggcattcaccatctaccaaagactaatttagaacgaacacgcttggtttctagacaaatacggaacacgcctaggaagagctaggaagaccgacggactggttagttactttacgtttaggtttcgttttaggtttcgtacggtaccggtacgggttacggggggtaaacttacccgtttacgtaacggtccgtacgggttaccggggggacccgtaccgggggtaccctacccgggttccggttaccgtacccggtttccccgttcccgtacccgtaccggtacccccgtacccgaacccggaacccgggtcccctaaccggttccccggtttcccttccccccggttacccggtaccccgtacccccgttaccctaccccgtaacgtaaccggtacccgtaacccggtccgggttccgggggacccgacccggtacccgggtcccccgggg

SEQ ID NO: 59177 - DNA, 725 bp, Homo sapiens
  misc_feature: GYAE6OF02IY1MB.10.53.E09.1.454.CMB.1.raw
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttacgcctctggattcaccttcagttagttatcctttgcacgtgggtccgtcaggctccaggcaaggggctggaggtgggtggcagttatcctntatttgagtggagaataataaatactacaganacgtccggttccggggctattcacctatctaccaaagactaaatttaggaaacaacacggcttgttactagtaccaaagtcgaaactaggacccttaggacgtacggtctaagggtaacggaccgaacgggtcgttaggtttacggtttaagttttaccgttttacgggttttcgggttttttacgggtttaccgtttcgggtaccggtttccggggtaacgggggttaaacttaccgtttaccgagtccgtaacggtcgggggacccgacgggtcccgtacccgtggtaccctccgttctcccgtacgacgtcccacccgtaaccgaccggtaccctcggtacccgttcccgttaccccgtggaccccttaccccgtactaacccgacgtacctcccgacgtccggtacggggccaccggtcgtcccgggg

SEQ ID NO: 59178 - DNA, 513 bp, Homo sapiens
  misc_feature: GYAE6OF02F56B6.10.53.E09.1.454.CMB.1.raw
  modified_base (312)..(312): a, c, t, g, unknown or other
  misc_feature (312)..(312): n is a, c, g, or t
  modified_base (423)..(423): a, c, t, g, unknown or other
  misc_feature (423)..(423): n is a, c, g, or t
tcagcatagtagtgcacgaccggtgctcgatttagagagagtgtgttggggtttgggggagctacaacaggcaggcaggggcagcaagatggtggttcgcagacccaggtcttcgatttctctgttgctctggatctctggtgcctacggggacatcgtgatgacccagtctccagacctccctgcctgtgtctctgggcgagagggccacatcaactgcaagtccagccagagtgtttatcagctcgacaataagaactactagcttaggtaccagcagaaaccaggacagcctcaagctgctcatttacngggtcatctacccgggaactcccgggtcctcgaccgtatccgagtggcaggcggtctgggacagtagtttccactctcaccatcagcagcctgcaggctagagatcgcgtntagttatatcgtacagtacacttattactacgtacccattcgactagtcgacctaggaaccaaggtgagactacgaactacgtgtggtac

SEQ ID NO: 59179 - DNA, 758 bp, Homo sapiens
  misc_feature: GYAE6OF02FUAGB.10.53.E09.1.454.CMB.1.raw
  modified_base (326)..(326): a, c, t, g, unknown or other
  misc_feature (326)..(326): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagacgggccaccatcaactgacaaggtccagccagtagttgttttatcagcctccgacaataagaactacttagcttaggtaccagcaagaaccaggacacgcctacctaagctgctactagtttacgngggactactacccgtacccggggtaacgtcccggggtaccctacggaccgtattccgaagggttcggaccgtacggggtccggggttaccgtagggggaacctagggttaactttccgaccgttacctacccgaacctacgtaccgaacggtaccgtaacggtcccgttacggaccgtaagggtccgtaaggtaagtaccgttcgggaccgggttacgttaacggttttttaacgttaccgttacgggtttaccacgggttaacctttaaccgtttaacgttttaaccgttaaacccgttaaccccccttagtttacccgaaccgtttaccggtttcccgggtaaccccggttacggggtaaacccgttaaaagggtcggtaaacgtacgttaaaccggtaaaccggtacggtttacggtacggtaacccgg

SEQ ID NO: 59180 - DNA, 699 bp, Homo sapiens
  misc_feature: GYAE6OF02FTGVU.10.53.E09.1.454.CMB.1.raw
  modified_base (259)..(259): a, c, t, g, unknown or other
  misc_feature (259)..(259): n is a, c, g, or t
tcagcatagtagtgcacgaccggtgctcgatttagagagagtgtgttgggtttgggctgagctgggtttcctcgttgctcttttaagaggtgtccagtgtcaggtgcagctgggtggagtctgggggaggcgtggtccagcctgggaggtccctcagactctcctgtttagcctctggattcaccttcagtagttactcctttgcactgggtccgtcaggctccgaggcaaggggctgggagtgggtggcagttatctnattgatggagacaataaatactacagagactccggttcggggcatcaccatctaccaaagacaattagaacgaacacgtcttgtttctagactaaagtacgtaacacgcctaggaagagcgtagacggacgacggcgtagtagttacttagttcggtttcggtttggtttcgtgtacgttacgggtacgggggtaaacttacccgttacgacgaccgtacgtccggggaccgaccgggtacccgaccccgtcgggttacccgtacccgttcctacccgtaccgtaccgtaccccttacccgaacccgaacccggtccccgtaccgttcccgggttaccccttcccccgtcgggtacccctacccctcccgtaaccccgaacggtaccgacccgtaccccggtaccggtaccggggaccgtaccgtaccggtacccccggg

SEQ ID NO: 59181 - DNA, 741 bp, Homo sapiens
  misc_feature: GYAE6OF02FGVTO.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtacctacggggacatcgtgatgacccagtctccagactccctgcctgtgtctctgggcgagagggccaccatcaactgcaagtccagccagagtgttttattcagctccgacaataagaactactagcttaggtaccagcagaaaccaggacagcctacctaagctagctactatttacgtgggtctactccgtaacccggggtaacgtcccgggggtcccctggacccgtattaccgacggtcggacgagggtccggggtcgttacggggaactaggtacttttacctaaccttccgtaccaacccgtattaccgaacggacctacggacccgttccggacgtacgggtaccgttacggaaacggtacgttacgggtaccgggtacgtttaacggttttttaacgttaaccgttcgttaaccgtaacgggtaccctaaacgtttaaactttaaccgttaaacccgttaacccccgtaacttttaacccgaccgtaacgtttccccgggtaacccccggttaacggggtaaaccccgtaaagggtacggtaaacggtaaccgtaacgtaaaaccggtaacgttacggttacgggtacctaccgg

SEQ ID NO: 59182 - DNA, 558 bp, Homo sapiens
  misc_feature: GYAE6OF02FJ06G.10.53.E09.1.454.CMB.1.raw
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttggtaccagcaagaaaccaggacagccctcctaagctgctcatttacngggctatctacccgggaatccgggtcctgaccgtattcagtggcnggcggtctgggacagtactttcactctcaccatcagcacgccgtgcgacggctagaagntcgcggctaagtttacttaacgtgtcacgactaacttattaacgttacgtacccctagttccaactacgttaccggcccgttacgggtaaccgtaaggtacggaacggtactaaccgaaacgtaacgtagtacggtacg

SEQ ID NO: 59183 - DNA, 568 bp, Homo sapiens
  misc_feature: GYAE6OF02HZQ9M.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctctaagctgctcatttactggcatctacccggaatccggggtccctgaccgattcagtgcagcgggtctgggacaggtatttcacttctcaccatcagcagcctgcaggctagaagagtgcggtctagtttacttacgtcgtacagcctaacttattaacgttaacgtaccccctaattccaaccgtactttcccgggacccgttggggaaaccctaaagggtggaacgtaacgttaccgtaaaacggtaaccttagggtacggtaccgttggtaaccccg

SEQ ID NO: 59184 - DNA, 596 bp, Homo sapiens
  misc_feature: GYAE6OF02GI3ON.10.53.E09.1.454.CMB.1.raw
  modified_base (266)..(266): a, c, t, g, unknown or other
  misc_feature (266)..(266): n is a, c, g, or t
  modified_base (392)..(392): a, c, t, g, unknown or other
  misc_feature (392)..(392): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtgcagttatctcatttgatgganacaataaatactacagagactccggttacggggccattccaacctatctaccaaagacctaagtttgaagtaaccacggcttgtttctgactaaatgaacagcctgagagctggaaggacacggtntgtgtaactttacgtgttcgtttggttctacgacttcggtacgggggtaacttaccgtcacggcacggtcgggaccgacgggccaccgtcggtcccgaccgtcctcctcacgccctccaaccgacggcccacgtccggtcctcccgtcggcctaccctcctaccaacgtcaccgtaccgtccggtacgggccacgacgcccggg

SEQ ID NO: 59185 - DNA, 674 bp, Homo sapiens
  misc_feature: GYAE6OF02JNG56.10.53.E09.1.454.CMB.1.raw
  modified_base (219)..(219): a, c, t, g, unknown or other
  misc_feature (219)..(219): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
tcagcatagtagtgcacgaccggtgctcgatttagagagagtgtgttgggtttgggctgagctgggtttcctcgttgctctttaagaggtgtccagtgtcaggtgcagctggtggagtcgtgggggaggcgtggtccagcctggggacggtccctcagactctcctgtttacgcctctggattcaccttcagtagttatcctttgctactgggtccctnaggctccgaggcaaggggctgggagtgggtgcagttatctctatttgatggagacaataaaatactaacagagaatccggttcggggacctattccaccatcctaccaaagacaatttgaagaacacgtcttgtttacngactaaactgaaacctgacctgacgtagctggaggacacggntggtatattacgtcgtttcgtttgttctgtacgttcggtacggggtaacttaccgttacgacgtacgacggtcgggaccgtacgggtaccacccgtggtacccgtaccgttccctcccgtcgtaccgcccttacccgaaccggtaccggtaccctacgttcccgttccccgttccccggtaccggtccccgtaaccccttcccgtacccgtaaccgtaccgtacccgtacccggtaccggtaccggggtaccctaccggtaccggtccccgggg

SEQ ID NO: 59186 - DNA, 757 bp, Homo sapiens
  misc_feature: GYAE6OF02JA2SE.10.53.E09.1.454.CMB.1.raw
  modified_base (285)..(285): a, c, t, g, unknown or other
  misc_feature (285)..(285): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcacgtgggtccgtcaggctccaggcaaggggctgggagtggggtggcagttatctcatttgatggagacaaataaatactanagagactccgttcggggccatcaccatcaccaaagactaatttggaacgaacacgtctacgtttcgacgtacaaaagttcgaaactacggcctaggtaaggacgcgtaggtaacggaccgtacgggaccgtagttagtttaacgtttacgtttcgggttttacggtttttcggtttacgtacggttaccgttacggggttacgggggtaaacttacccgttacgacgtacgttacggtacggggcccgacggggaccctacccggttcggttaccctacccggttcccttcccgtaccgaccgtcccctacccgtaacccggaaacccgggtcccctaaccggttcccgggtttcccccttacccccggtaccggtccccttacccccgttacccgttacccgaaaccggttcccgtacccgtacccggttcccgggtacggggtccctaaccgggtcgggtacccccgggg

SEQ ID NO: 59187 - DNA, 517 bp, Homo sapiens
  misc_feature: GYAE6OF02GIJAX.10.53.E09.1.454.CMB.1.raw
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
  modified_base (513)..(513): a, c, t, g, unknown or other
  misc_feature (513)..(513): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctccgacaataagaactacttagcttggtaccagcagaaaccaggacagcctctaagctgctcatttacnggcatcctacccgggaatccggggtcctgaccgattcagtggcaggcggtcgtgggacagtatttcactcncacatcagcagcctgcgaggctagaagntgcgtctagtttatcgtgtcacgtcacttattactacgtaccctattaccactattccggaccctagggaacctaaggtgaacgactacaaacgtacgtggtacgcngacc

SEQ ID NO: 59188 - DNA, 646 bp, Homo sapiens
  misc_feature: GYAE6OF02H7JH2.10.53.E09.1.454.CMB.1.raw
  modified_base (202)..(202): a, c, t, g, unknown or other
  misc_feature (202)..(202): n is a, c, g, or t
  modified_base (332)..(332): a, c, t, g, unknown or other
  misc_feature (332)..(332): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctgcctgtgtctcgtgggcgaggngggccaccatcaactgacaacgtccagccagtagttgttttattcagctaccgacaaataaagaactacttagccttggtaccagcaagaaaccacggacacgtcctacctaagctgcctactattacgnggctactaccgtaaccgggacgtcccgggtaccctggaccagttacgaggtcggcgtacggtcggtacgtcgggacagtactttcactcgtacacctactacagcacgtcctgcgacggcgttagaagtgtcgcggtacttagttttacgttacgttctacgagtacctaactttacgttaacttaacccgtaaccccttacttaccaaccgttaccgttacccggtaccccggtaacggggtaacccgtaaaaggttaccgggtaactaacggttaaaccgtaaaccggtaacgtttacggtacgttacccgg

SEQ ID NO: 59189 - DNA, 776 bp, Homo sapiens
  misc_feature: GYAE6OF02F2JQO.10.53.E09.1.454.CMB.1.raw
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
tcagcatagtagtgcacgaccggtgctcgatttagagagagtgtgttggggtttgggggctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggngcgtggtccagccgtgggacgtccctnagacctctcctgtttacgcctcgtggattccacctttcaagttagttattccgttttgcctacgttcggggtcccgttcgacgggtcctcccgagggccgaagggggtctacgggtaggttggggtcggaccgttaaggttacgtccttacgttagtttcgtaagtaggggtaacgaacgtaaaattaaactaactacgtaagaacgtaccgtccgggttacggggacccgtaactttccgaaccctacgttaccgtaaaccgaaaacgttaaacctaaaggtttaacgaaacggtaaacccgtacggttacgtttacgttttccgtaacgaacgtaaacgtacgtaaaccgagtaaccgtaggtaacgacgtacgtacgggtaacgaccgtaaccgggtaccgttagttagttaacgtttacggttttcggttttaaccggttttgggtttcctagggttacccggtttacgggggttaccgggttaaacctttccggtttaacccgacggtacccgtaaccgggg

SEQ ID NO: 59190 - DNA, 760 bp, Homo sapiens
  misc_feature: GYAE6OF02HET6F.10.53.E09.1.454.CMB.1.raw
  modified_base (260)..(260): a, c, t, g, unknown or other
  misc_feature (260)..(260): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggagcgtgggtccagcctgggaggtccctcagactctcctgtttagcctctggattcaccttcagttagttatcctttgcacgtgggtccgtcaggctccagggcaaggggctggagtggggtgctagttatctntatttgatggagacaataaatactacagagactccggttcggggccattcacctatctaccaaaagactaatttagaaagaacacgtcttggtttctagactaaatcgaaacaggtcctggtaagagtcgtaggaacgggaaccacgggcttaggtagttaatttaacgttcggtttcgtttgggtttcttcggtaccgttcggggtaccgggggtaaactttacccgttaccgacgtaccgtaaccggttcggggggacccgtacggggtaccctaaccccggttcgggtacccgtaaccccggttaccctccccgtttacgacccggtaccccttacccgaaccccggtaaccgggacccctacgttccccggttccccgttacccccgtccgggtaccccttaacccccgtcccttaacccgaaccgggtaccgtaccccgtaaccccggttccgggtacccggggggtccctaaccggtcccgggtacccccgggg

SEQ ID NO: 59191 - DNA, 807 bp, Homo sapiens
  misc_feature: GYAE6OF02H7B1E.10.53.E09.1.454.CMB.1.raw
  modified_base (160)..(160): a, c, t, g, unknown or other
  misc_feature (160)..(160): n is a, c, g, or t
  modified_base (765)..(765): a, c, t, g, unknown or other
  misc_feature (765)..(765): n is a, c, g, or t
tcagcatagtagtgcacgaccggtgctcgatttagagagagtgtggttgggtttgggctgagctgggttttcctcgttgctcttttaagaggtgtccagtgtcaggtgcagctggtggagtcgtgggggaggcgtggtccagccgtggggacggtccctnagactctccttgtttagcctcgtggtattccaccttcagttagttacttcctttgctacgttgggtccgtcaggcctccgaggacgaagggggctgggaggtggggtcgctagttatctctagtttgagtaggagaactaaattaaactactaacaagacgtaccgttcccgggttcggggacctacgttaccaacctacttaccgtaaccgaaaacggtaccttaaacgttttaacggaaacggtaaaccgtacggttccgtttacgttttaccgtaggtaaacctaaagttacggaaaccgtacggtacccgttagaagacggtacgtaggaaccgggtaccgtacgggtcgttaggttaacgtttacgtttacgtttacggttttcggttttggttcgttaggtaccgttcggggttaacgggtactacgttacgaacgtcgtaaccgggtcgggacgtacgggtacctacccggttacggtcccaccgttccctacccgtcgaccgttacccgacccgtaacccgggacgtccccgttaccgttcccggttaccccgttccccgacggtcccctacccttaacccgtaccgaacggtaccncccgttacgggaccggtcgggaccctaccggcggtccccggg

SEQ ID NO: 59192 - DNA, 518 bp, Homo sapiens
  misc_feature: GYAE6OF02FXJRP.10.53.E09.1.454.CMB.1.raw
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagatgtttatcagctccgacaataagaactacttagcttggtaccagcagaaaccaggacagcctcctaagctgctcatttacngggcatcaccgggaatccgggtcctgaccgntcagtggcagcggtctgggacagatttcactcgcaccatcancagcctgcagctgaanatgcgctaagtttatactgtacagcacttattatacgtaccctattaccactacgttaccggcccgtagggaacccaaggttaggacgaactaccgaaacgtaactcggtcggtaccg

SEQ ID NO: 59193 - DNA, 751 bp, Homo sapiens
  misc_feature: GYAE6OF02HOGUW.10.53.E09.1.454.CMB.1.raw
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatcgacccagtctccagacctccctgcctgtgtctctgggcaggacggccaccatcaactgcaagtccagcctagngttgttttatcagcctccgaanaataagaacttacttacgcttggtaccagcaacgaaccnggacancctcaacgctagcctctactttacgnggcactccgtaccgggactccgggtccctcgaccgtattacgacggtcggcgtacgggccgggttcgtacgggaccgtaaggttcgttttaccaaccgttcctaccgtaaacccctagtacccaaggtacctaacggtcccgttagggacctacgggtaccgttaagggaaacgtacgggtcggaccggttaaacgttaacgtttttaacgttaaccgttacggtaccgttaacggtaaccttaaaccgtttaagttttaaaccgtaacccgttaacccctttagttacccgtaacctttaacccgggtttcccggaaccccggtttaacgggggaaaaccccggttaaaaggttcccgggtaaacttaaacccggtaaaccgtaaaaaacgggttaacccggttagggttaacccggtaacccgg

SEQ ID NO: 59194 - DNA, 700 bp, Homo sapiens
  misc_feature: GYAE6OF02H2QSF.10.53.E09.1.454.CMB.1.raw
  modified_base (336)..(336): a, c, t, g, unknown or other
  misc_feature (336)..(336): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
tcagcatagtagtgcacgaccggtgctcgatttagagagagtgtgttggggtttggggggagctacaacaggcaggcagggggcagcaagatggtgttgcagacccaggtcttcatttctctgttgctctggatctctggtgcctacggggacatcgtgatgacccagtctccagactccctgcctgtgtctcgtgggcgaggacgggccaccatcaactgacaacgtccagccagtaggttgttttatcagcctaccgacaaataacgaacttactagcttggtaccagcaagaaaccaggacagccctactaacgctgccttactattttacgngggacctagtacccgtaacccggggtaaacgttccccggggtcccctacggacccgtacgttcgaggtggacacgggtcgggtctaggggacagtactttaccacttctaccacctacgtaccagtccaacgtcccgngccagggtcctaggaaacgtntacgggaccggtacttaaggttttaacttacggtacgttcgaacgtaccttaactttaacgtttaacgttaacccgttacccttaacgttaccctaacgtttcggtttaaccccggggtaccccgtaacgggggtaaaaccctaaacgggttcgggaacgtaaacggttaacccgaaaacggtttaaccgttgggtacgggtacc

SEQ ID NO: 59195 - DNA, 753 bp, Homo sapiens
  misc_feature: GYAE6OF02JPLNU.10.53.E09.1.454.CMB.1.raw
  modified_base (163)..(163): a, c, t, g, unknown or other
  misc_feature (163)..(163): n is a, c, g, or t
  modified_base (179)..(179): a, c, t, g, unknown or other
  misc_feature (179)..(179): n is a, c, g, or t
tcagcatagtagtgcacgaccggtgctcgatttagagagagtgtgttggggtttgggggctctgggagacgagcccagcactggaagtcgccggtgtttccattcggtgatcatcactgaacacagaggacccacatggagttgggctgagctgggttttccncgttgctcttttaagnggtgtccagtgtcaggtgcagctggtgagtcgtgggggagcgtggtccaggtacccgtcgggaggtccctctacgacctcgttacctcgttacgccgtctcggacttcaccgttcgtaagttacgtttagtcccgtttagtcggtaccgtacgggtaccggtccgtaccggacgtaccgaaggggccgtaaagggggcgttaggggtacggtcgggtaggtacgtagttactacgttacgagtttaggaagttacggaaagtaaactaaacgtaaactaacgtaacgaacggtaacggtaccggtacccggttacggtaccgtacgttacctaaccgtaacgtaacgtaacctaaagtaacgtaaagttaacgaaacgtaacgtaacgttcgttacgttacgtaacgtaacgtaaacgtacgaacgtacgaacgtagtaacgtagacgtacgaacggtacgtaacggtacgttagttagttacgtttacggtttcggtttacgtttacggttacgttacggttaacggttacggttaccgggtaacttaccggttacggtacggtacggtacgg

SEQ ID NO: 59196 - DNA, 647 bp, Homo sapiens
  misc_feature: GYAE6OF02I5KIF.10.53.E09.1.454.CMB.1.raw
  modified_base (368)..(368): a, c, t, g, unknown or other
  misc_feature (368)..(368): n is a, c, g, or t
  modified_base (413)..(413): a, c, t, g, unknown or other
  misc_feature (413)..(413): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacgggacatcgtgatgacccagtctccagactccctgcctgtgtctctgggcgagagggccaccagtcaactgacaagtccagccagagttgttttatcagcctaccgacaataagaactacttagcttaggtaccagcaagaaaccaggacagcctacaagctgctacatttacgtggacagtcctaaccgggaacgtccggggtccctagaccgtattacgacgtggcnggtaccgggtcgtaggggacaagtactttccaacttctcacctanacagccacgctgacacggctaggaacgtatcggacggaccgttagttttaacttacgtacgttaccgaagacctactttaacgtttaacgttaaccgttaaccccctaagttaaccctaacgttaccgtttacccggaccccggttaccggggtaaacccgtaaaagggttacggaacgtaagttaaacccgtaaaaccgtaacggttacggtacgggtacccgtgtaaccccg

SEQ ID NO: 59197 - DNA, 571 bp, Homo sapiens
  misc_feature: GYAE6OF02I5JGV.10.53.E09.1.454.CMB.1.raw
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (465)..(465): a, c, t, g, unknown or other
  misc_feature (465)..(465): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtggggggaggcgtggtccagcctggggaggtccctcagactctcctgtttagcctctggattcaccttcagtagttatcctttgcacgtgggtccgtcaggctccgaggcaaggggctgggaggtggggtggctagttatctctatttgatggagacaaataaatactacagagactccgtcggggcctattcaccatcnccaaagactaatttgaanaacacncttnttctnacaaatgaacagcctganagctagagacacggntgtagtattctgtttcgtttgtctgactcggtcgggaacttctcagcacggtcgggcgacggctacccgtggtcccnccgtctcctctcgccctccgaccgacggccctcgtccgtcccttcccgtcgtcccaccctccgaacctacggcgccctccgtcggtcgggcctacgacggtcccgg

SEQ ID NO: 59198 - DNA, 676 bp, Homo sapiens
  misc_feature: GYAE6OF02FFGLP.10.53.E09.1.454.CMB.1.raw
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtgagtctggggaggcgtggtccagcctgggaggtccctcagactctcctgtttagcctctggattcaccttcagtagttatcctttgcactgggtcctcaggctccaggcaaggggctgggagtgggtgcagttatctctattgatggagacaataaanactacagagtactccggttcggggccattcaccatctaccaaagactaatttgaagaacacgctgtttcngctaaagtcgaacngcctagagacgctaggagaccgaggctgttagtattacttcgtttacgtttggttctgtacgttcggtacggggaacttacccgttcgacgcgtacgtcggggaccgagggcctaacccgtcgggtaccgtacccggttccttacccgtcgtaccgtacccttacccgaaacccgtaaccgggccccttaaccgtcccgggtttaccccttcccccggtcgggtaaccccctcccccgttaccccgtaacccggtaacgacccggtccctaacccggtcccggggtacggggcccgtaccgtacccgggtaccccgggg

SEQ ID NO: 59199 - DNA, 635 bp, Homo sapiens
  misc_feature: GYAE6OF02GO0AH.10.53.E09.1.454.CMB.1.raw
  modified_base (326)..(326): a, c, t, g, unknown or other
  misc_feature (326)..(326): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgaggacgggccaccatcaactgacaagtccagccagtagttgtttatcagctccgaacaataacgaactacgttagcttggtaccagacaagaaaccaggacacgcctactaagctagctacatttacgnggacattccgaaccgggactccgggtacccagtacctagttccgaggtcggacgacggtcggtaccgtagggaactgtaactttccgacttctaccaactacgtaccgtacgacctacgacctacggacgtaaggtcctaggaacgagtcgaccgtacgttagttttaacgtacttcgtacgacgtacttaactttaacttacgtaacccgtaacctacgtttaccaacgttacgttccccgggaaccgttacgggaacctaaacgggtggaacgtacttaaacgaaaccggtacttcgggtacgaccg

SEQ ID NO: 59200 - DNA, 620 bp, Homo sapiens
  misc_feature: GYAE6OF02HTM61.10.53.E09.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactncaagtccacgccaagngttgttttactcagcttaccgacaaataagaacttacttagcttggaccagcagaaccaggacagcctactaagctgcctnatttacgnggctatccgaccggacgtcccgggtcctaggacctatcgagtcggcaggtccggtntggggacagtactttcacttcaccaacgtntaccgagtcagtccgtagcgtacgggactagggaactagtcgtaccgggactaaggttttacttacgtcgtacacgtcctaaatattaccgttaacgtaccctatttaccacgttaccgttccggaacccgtacgggtaaaccgtaacgggtacggtaacgttaacgtaaccgttaaaaccggtaccgtttacgggtacgtaccggttactaacccgg

SEQ ID NO: 59201 - DNA, 651 bp, Homo sapiens
  misc_feature: GYAE6OF02GBO0G.10.53.E09.1.454.CMB.1.raw
  modified_base (381)..(381): a, c, t, g, unknown or other
  misc_feature (381)..(381): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctggattcaccttcagtagttatcctttgccacgtgggtccgtcaggcctccgaggcgaaggggctgggagtgggtggctagttatctctatttgatggagaacaaataaatactaacagagactccggttacggggccattccacctatctaccaaagactaagtttagaaagaacacgtcttcgtttctagacaaatagaaacngcctaggaagacgacgtagaaggacgacggtcgttgtagttacttacgttgtttcgtttggttcgtcggtacgtcgggtacggggtaacttaccgttcgacgtccgtacggtcggggacccgacggcccgtacccggtcggtacccgtaccgtcctacccgtcgtccgccctacccgaaccgaccggccctacgtccgtcccttccccgcgccctacccctcccgacccgaacgaccgccgaccgtccggcgggaccacgacggtcccgg

SEQ ID NO: 59202 - DNA, 616 bp, Homo sapiens
  misc_feature: GYAE6OF02IY2XQ.10.53.E09.1.454.CMB.1.raw
  modified_base (252)..(252): a, c, t, g, unknown or other
  misc_feature (252)..(252): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
tcagcatagtagtgcacgaccggtgctcgatttagagagagtgtgttgggtttggggtctgagctgggttttcctcgttgctcttttaagaggtgtccagtgtcaggtgcagctggtggagtctgggggaggcgtggtccagcctgggaggtccctcagactctcctgttagcctctggattcaccttcagtagttatcctttgcactgggtcctcaggctccaggcaaggggctggagtgggtgcagttanctcatttgatggagacaaataaatactacagagactccgttcggggccaattccacntctccaaagacaatttgaanaacacgtntgttctgacaaatgaacacgcctagagangtcgagaacgtcggctggttagtaattacgttgtttcggtttacggtttctcgtacgtcggttacggggtaacgttaccgttacacgtcacgttcgggaccgtagggcctaccggtcgtacctaccgtccttccgtactacgcctacccgtaccaacggcccacgtccggttcctacccccggtgccctaacccgttcctacccgaacgtacgaccgtaccgtccgtcggggctacggacgtaccccggg

SEQ ID NO: 59203 - DNA, 713 bp, Homo sapiens
  misc_feature: GYAE6OF02F22FP.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagacgggccaccatcaactgacaagtccagccagagttgttttatcagctaccgacaaataagaactacttagcttaggtaccagccaagaaaccgaggacagcctaccaagctagctacatttacgtgggactacgtccgtaacccgggaacgttccccggggtaccctacggacccgtacttcgacggtcggaccgagggtccggggttcgtacggggtaactggttaactttccgaccttccgtaccaccgtaataccgacgccacggtccctaggaccgtacgggacgtacggaaaggtacgtcgggtaccggtactaacggtttttacgtaaccgttcgtaccgtaaggaccttaagttaaacttaaacggttacgtaccgtaccggggtacccccggtacggtaacccgggtttaccggggaacccggtaaacgggggtaacccggtagggttaaccgggttaaacttaaccggaaaaaccgggtacgttcgggtacggtcctaaccggg

SEQ ID NO: 59204 - DNA, 792 bp, Homo sapiens
  misc_feature: GYAE6OF02HMQTD.10.53.E09.1.454.CMB.1.raw
  modified_base (182)..(182): a, c, t, g, unknown or other
  misc_feature (182)..(182): n is a, c, g, or t
  modified_base (440)..(440): a, c, t, g, unknown or other
  misc_feature (440)..(440): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagttgggctgagcttgggttttcctcgttgcttacttttaagnggtgtccagtgtcaggtgcagtctgggtaggaggtcgtggggggacgtcggtcggtaccaggcccgtagggacgtccctgacgaccttctccgttagtttacgcccttgtggtaacttccgtaacctttcgtaaggtttacgtttacttcctttgaccgtaccggttacggggttccctcgacgggtcctaccggaacggtaccgggtaagggggtcgtaggggtacgggttcggggtacggtacgtaaggtttaacnccttaccgttaaggttttcgaaggttcgggaaacgtaaactaaaagttaaaacgtaacgtaacgtaaacggtacggtaccggttacccgggttccggggtaccgtacgttacccgtaacctacttaacctaacccgtaaaacggtaaacttaacgttaacgaaacgtaaccgaaccggttctttacgtttacgtacgtaactaatacggaacgacgtaccgtacggtaacgacggtacgtaaggtaacggacgtacgtactgtacgttcgttaacgttcggtttacgtttaggtacgttacggtacggttaccgggtacgggttaacctaccggtagtaccgtacgtacggg

SEQ ID NO: 59205 - DNA, 971 bp, Homo sapiens
  misc_feature: GYAE6OF02HL429.10.53.E09.1.454.CMB.1.raw
tcagcatagtagtgcacgaccggtgctcgatttagagagagtgtgttgggtttgggctgagctgggttttcctcgttgctctttaagaggtgtccagtgtcaggtgcagctggtggagtcgtgggggaggcgtggtccagcctgggagtccctcagactctcctgtttacgcctctggattcaccttcagttagttatcctttgctacgtcggggtccgtcacgggcctccgaggcgaagggggctgggagtggggtggctaggtttatctctatttgagtggagacaataaatactacagagactccggttcggggccgtattaccaccactcctaccaaagaactaatttagaagtaacacgacttggtttctaggacctaaatacgtaaacacgtaccgtaggaaggacgtccgttaagggaacgggaaaccgtaaccgggtcgttaggttacggtttaacgttttaaccggtttcgggtttttcccgggttttttcggggtttaccgtttacgggtaacccggtttaccgggggttaaccgggggggtaaacctttaacccgggtttaccgtaaccgggtacccggttaaccggggttacccgggggggtacccgaaccggggggtaccccgtaccccccgggttacgggttaccccgtaaccccgggttccccgttacccgttacccgtaaccccggtccccgtttaacccccgtaaaccccggggtaaaccccggggaccccccgttaaccgttttaccccccgggggtttaccccccgttttaccccccccgggttacccgggtaccccccccgttaaccccccgttccccccggttaaaccccccggtaaaacccggggttaacccggtaccccccgttaaacccccggggttccccgggggttaacccgggggggtaacccccgtaaacccgggccccggggtttaaccccccccggggggg

SEQ ID NO: 59206 - DNA, 912 bp, Homo sapiens
  misc_feature: GYAE6OF02GTHVI.10.53.E09.1.454.CMB.1.raw
  modified_base (281)..(281): a, c, t, g, unknown or other
  misc_feature (281)..(281): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtggggggaggcgtgggtcccagcctggggaggtcccctcagacctctcctgtttagcctctggattcaccttcagtagttattcctttgccacgtgggtccgtcacggcctccgagggcgaaggggctgggagtggggtggcagttactctctatttgntggagaactaataaatactacgagaacgaccttccgggttacgggaccgtatccaaccacttccaaccaaaacggtactaaagtttacggaaacgtaacctacggtacttcggtttacctagaacctaaaagttacgaaaccgaacgtacccgtaggaacgtacggtacgtacgggaacgggtaaccgaccgggtacgtttacgtacggtttaacgttttaacgtttcgggttttacggttttcggtttaccgttacggttaccgggttaccgggtaacggggtaaaccgttacccgttacgaacggtaccgtaaccgggtaccggggtaccggtaaccgggtacccgtacccgggttacggtacccggtaaccccggtttaccgtccccgttaaccgtacccggtaccccgttaaaccccgtaaacccgggtaaaccccggggtaaccccgtacccggtttacccccgggtttacccccgttaccccccggttaccccggggtaccccctttaaccccccggttaacccccttaacccgaaacccggttaccccggtaacccggtaccccgggttacccggggtccccggggaacccggtaccccgggtaaccccgggtccccccggggg

SEQ ID NO: 59207 - DNA, 759 bp, Homo sapiens
  misc_feature: GYAE6OF02F520R.10.53.E09.1.454.CMB.1.raw
  modified_base (305)..(305): a, c, t, g, unknown or other
  misc_feature (305)..(305): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctggattccaccttcagtagttactcctttgcacgtgggtcctcgaggctccgaggcgaagggggctgggaggtggggtcggctaggttatctactagtttgagtggagaactaaataaaagtacctaanacggagtaccgttccgggttacggggaccctacgttaccaaccgtactacctaaccgaaaagtaaccgtaagtttaaggaaacgtaaacgaccggttacgtttgtttaccgacggtaactaaaacgtcgtaaaaccgagtacccgtaggaaggacgtcgtaggaacgacgacggtcgtgtacgtttaagtttcgttggtttacgtttgtccgtagtaccggttcgggtacgggtaacttaccgttcgaacgtcgtaacggtcgggaccgtacgggccctacccggtgttaccccgtacgtccctaccgcgaccgtacccgtacccgaacccggaccggtaccctccgttcccgttccccgttccccgtaccggtaacccctaccccgttccctaacgtaaccgaccgaccgttcccggtacgggtaccggggtacctacccggcggtccccggg

SEQ ID NO: 59208 - DNA, 696 bp, Homo sapiens
  misc_feature: GYAE6OF02HR047.10.53.E09.1.454.CMB.1.raw
tcagcatagtagtgcacgaccggtgctcgatttagagagagtgtgttggggtttgggggacaacaggcaggcaggggcagcaagatggtgttgcagacccaggtcttcatttctctgttgctctggatctctggtgccgtacggggacatcgtgatgacccagtctccagactccctgcctgtgtctcgtgggcggaggacgggccaccatacaactgacaacgtccagccagtagttgttttactcagtcctaccgaactaaataaacgtaaacttaacttaggtactttacggtaaccagaccaacgaaaaccgtaggaaccacgccctaccgtaacgctcgtctactaacgtttacgtcgggactacgtaccggtaaccggggtaacgtcccgggtaccctagtaaccgtactttacgaggtcggacgaacggtcgggtacgtagggaactaggtactttccacgttctaccaacctagtacacgtaccgacgtacctacggacctacggacgtaaggtaaacgtagtcggtaccggtacttaacgttttactacgttacgtacaacgtactaacttaattaaccgttaaccgtaaccctagtacctacttacgttaccggaccggtacgggaacctaacggtaggtaacgtaacgtaacaaacggtaacgtaggtacggtacaccggtaacc

SEQ ID NO: 59209 - DNA, 816 bp, Homo sapiens
  misc_feature: GYAE6OF02JABYS.10.53.E09.1.454.CMB.1.raw
  modified_base (576)..(576): a, c, t, g, unknown or other
  misc_feature (576)..(576): n is a, c, g, or t
tcagcatagtagtgcacgaccggtgctcgatttagagagagtgtggttgggtttggggacaacaggcaggcaggggcagcaagatggtgttgcagacccaggtcttcatttctctgttgctctggatctctggtgcctacggggacagtcgtgatcgacccagtctccagacctccctgcctgtgtctcgtgggcgagacggccaccatcaactgcctaaacggtccacgaccgaaggtagtttgttttaacttccaacgtccttaacccgaacgtaaactaaacggtaaaccttacgttaagtccgttacggtaaccagacaaacgtaaaccgacgggactacgaccttacctaacgctacgtcctacttacgtttacgtcgggtactacgtaccggtacccggggaacgtccccggggttacctacggacccgttagttcgtacggtacggacggtacggccggggttacgtacggggacgtaacgttactacccgtacgttcctaccgtaactacgttcgacgtactaccggtccgtacgtaacgcggtactacggaaacggtacgttccggngggttaccttaacggttttaccgtaacgttcgggtaactaccgtaacgttaacggttaacgttaacgttaaacccggtaaccctttaaccgttaccggttaaacccttaccgggttacccgggtaaccccggttaacccgggtaaaaccgggttaaacggttaacccgggtaaaccgttaccggtaaacccggttaaacgtaccggtttaccgggtccgggtaaccctcgggtaaacccc

SEQ ID NO: 59210 - DNA, 956 bp, Homo sapiens
  misc_feature: GYAE6OF02IDMH8.10.53.E09.1.454.CMB.1.raw
tcagcatagtagtgcacgaccggtgctcgatttagagagagtgtgttgggtttggctgagctgggttttcctcgttgctcttttaagaggtgtccagtgtcaggtgcagctggtggagtcgtgggggaggcgtggtccagcctgggaggtccctcagactctcctgtttagcctctggattcacctttcagtattatcctttgctacgtgggtccgtcaggcttaccaggccaaggggtctgggaggtggggtggcagtttactcgtctaattttgacgtgggtaagactaaaagtaaaactaactaacgagagacgttcccggttcggggacctattacccaaccgtattacctaaccgaaacggtaacttaacgtttagaaaacgaaaccgtaccgtacgtttaccgtttacgtaggtaaactaaagttaacggaaaccacggtacccgtaaggacgtaaacggttacgtacgggaaagggtaacccgtaccggggtaaccgttagggtttaacggttttaaacgtttttaacgttttacggggtttttccgggtttttttacggggttttaccggttacgggttaaccgggtttcccggggggttaaacgggggggttaaaacctttaccccggtttacggtaacggtacccggttaaaccggggttaccggggggtaaaccccttacggggggtaaccccgtaaaccccgggtttaccgggttaccccgtaaaccccggttcccgttacccgttaccccgtaaccgttacccccgtaccccgtaaaccccggttaaaccgggtccccgttaaccgggttccccgtttacccccgttcccccggtaacccgggtcccctaaaccccccgttccctaacccgttaacggtacccggtaccctacccggttacccggggtccggggtacccgaacccgggttacggccccccggg

SEQ ID NO: 59211 - DNA, 595 bp, Homo sapiens
  misc_feature: GYAE6OF02I3I1B.10.53.E09.1.454.CMB.1.raw
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
tcagcatagtagtgcacgaccggtgctcgatttagagagagtgtgttgggtttggggggagctacaacaggcaggcaggggcagcaagatggtgttgcagacccaggtcttcattttctctgttgctctggatctctggtgcctacggggacatcgtgatgacccagtctccagactccctgcctgtgtctcgtgggcgaggacgggccaccatcaactgacaacgtccagccagtgttagttttattcagctaccgaanaaataaagaacttacgttagtcttggtaccagcaagaaaccacggaacagacctacaagctgctatattacgnggcatccgtaccgggtactccgggtccgtcgaaccgtattacgagtggacgacggtcggtcgtagggacagtacgtttcactcctacacatcagcacgctgaccaggctagaacgagtcgacgacgttaagtttattacgtgtacagaactacttaattaactaccttaccccgtaattaccgtaacttaccggtcccggtaccgtaacgggtaaccgtaaaggtcggaatacgtaaacccgaacgtaggttgacggtaccg

SEQ ID NO: 59212 - DNA, 760 bp, Homo sapiens
  misc_feature: GYAE6OF02ITFIU.10.53.E09.1.454.CMB.1.raw
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagccgtgggacggtccctcagactctcctgtttagcctctggacttcaccttcagttagttacttccgtttgcctacgttcgggtcccgtcacggtcctccgaggccgaaggggtctgggagtggggtggctagttntctnatttgatggagacaagtaatactaacagacgactccggttcgggcctattccacccacgttcctaccgaaacgtactaatttaggaacgaacacggtcttcgttctagacaaagtacgaacagacctgagtagcgtagacggacgtccggtacttggttacttacgttacgttcgttttacggttttcggttcttacgtacgttcgggtacggggtacttacccgttagacgtccgtaacggttcggggacccgacggggtaccctaccccggttggtaccctacccgggtttaccttcccgtaccgtaccgtcccccgttacccgaaccgtaccggtacccctagggttcccccgttcccgttccccccggtcggtaacccccttcccccggtacccgtaaccccgaacgggtacccgttaccccgttacccggttaccgggttcccggggaaccctacccggaccgggtcccccgggg

SEQ ID NO: 59213 - DNA, 771 bp, Homo sapiens
  misc_feature: GYAE6OF02HZXX0.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtcgtggggggaggcgtggtccagcctgggaggtccctcagactctcctgtttagcctctggattcaccttcagtagttattcctttgcacgtgggtccgtcaggcctccgaggcgaaggggctgggaggtggggtggctagtttatctctagtttgatggagaacaaataaactactaacagagacttccggttcggggccgacttcacctactacctaccaagaactaagttagaagaacacgtctcgttctagtacaaatacgaacagccgtaggagagactagggaacggacgacggtcgtggttagttaacgtttacgtttaggttttccggttttggttacgttacggtacggttcggggttaacggggttaaaccttcccgttacgacgtaccgtcgggtcggggcccgtaacggggtccctaccggttcggtaccgttacccgtccgtacccgtccgaccggtaccccgtaacccgaacccggaaccggtcccccgttaccggttccccggtttccccccgtttccccccggaccggttccccccttaccccccgttaaccccgttaacccgaacggacccgtaccccgttacccggttcccggggtaacccgggggaccctacccgggaccgggtccccccggg

SEQ ID NO: 59214 - DNA, 583 bp, Homo sapiens
  misc_feature: GYAE6OF02FPW1L.10.53.E09.1.454.CMB.1.raw
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
tcagcatagtagtgcacgaccggtgctcgatttagagagagtgtgttgggtttggggacaacaggcaggcaggggcagcaagatggtgttggcagacccaggtcttcatttctctgttgctctggatctctggtgcctacggggacatcgtgatgacccagtctccagactccctgcctgtgtctcgtgggcgagagggccaccatcaactgcaagtccagccagagttgttttatcagctaccgaacaataagaactacttagcttaggtaccagcaagaaaccaggacagtccctacgtaagctgctctatttacgnggcatccgtaaccgggaatcccggggtcctgaccgtatcgagtggcnggcgggtctaggacagtatttccactctaccacatcagcagcctgcgaggctagaagtagtcgccggtacttagttttactacgttggtaccagtcctaattaagttaacgttaccttaacccgtaattaccacgttacgttcccggacccgttaacgggaaacctaagggtggaacgtaactacgaaacggtacttcggtacgtcctacgtaaccc

SEQ ID NO: 59215 - DNA, 737 bp, Homo sapiens
  misc_feature: GYAE6OF02JX1SB.10.53.E09.1.454.CMB.1.raw
  modified_base (571)..(571): a, c, t, g, unknown or other
  misc_feature (571)..(571): n is a, c, g, or t
  modified_base (614)..(614): a, c, t, g, unknown or other
  misc_feature (614)..(614): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctcgtggtgccgtacggggacatcgtgatgacccagtctccagacctccctgcctgttgtctcgtgggacgaggacgggcccaaccatccgaactggacaacggtccacgccgagtagttgttttatcgacgtctaccgaactaaacgtaacgtaaaccttacgttacgtcgttacggtacctacgacctaacggaaaacccgaggacctacgtccctaccgtaagccttcgtactaccgttagtttaccgacgggtactaacggtacccggttaacccgggtaaacggttccccgggttaccctaccggtaaccggtactttacgggacggttcggtaccggacggggttccggggttacggtacgggaacgttaaacgttcgtttaccgtacccgttactaccgtacctacgtaccgacgtacgcgtacgcgtaccgngtaccgtaggacgtcgtagtccggtagtttaagttcttacgtntaccgaacgtaccgttattaacgttacctaccgtaccctacttacacgttacggtcccggttaacggtcggaaaccgttagaaggtactaacgtaaccgtaacggtacgtaccggtgtaaccg

SEQ ID NO: 59216 - DNA, 758 bp, Homo sapiens
  misc_feature: GYAE6OF02H9NPD.10.53.E09.1.454.CMB.1.raw
  modified_base (746)..(746): a, c, t, g, unknown or other
  misc_feature (746)..(746): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctgattcaccttcagtagttactcctttgcacgtgggtccgtcgaggcctccgaggcgaaggggctgggaggtcgggtggctagttactctctagtttgagtggaagaactaaataaactactaacagagacgtccggttcggggaccgtatccaccattccgaccaaagtaactaactttaggaaacgtaactacgcgtttagtttctacgaactaaacgtacgaaaccgtacgacccgtagaacgagacgtacggacggaacgacggtcgtaggttagttacgttttacgttcggttttacggtttttcggtttaccgtggttaaccggttacgggttacgggggtaacctttaacccgttaggtaccggtaccgaccggggtacgggtaccgaccgggtacctacccggttcggtaccctacccgttccgtccctaccgccgtaccctacccgaaccggaccgcccgtaccgttccggttccccgttaccccgtcggacccctaccctccctacccgaaacggttcccgtccctaacccggttcgggtacccggggtactaccccggngggtcccccggg

SEQ ID NO: 59217 - DNA, 711 bp, Homo sapiens
  misc_feature: GYAE6OF02HF893.10.53.E09.1.454.CMB.1.raw
  modified_base (371)..(371): a, c, t, g, unknown or other
  misc_feature (371)..(371): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacagtcgtgatcgacccagtcctccagactccctgcctgtcgtctcgtgggcgaggacgggccacatcaacgtgacacggtccagccagtagttagttttatacacgtctacccgaacaaataaacgtaaccttacgttacgtcgttacggtaccagacgaaaccgtaaaacgacggaccacgtccctaaccgtaacgtcgtgtacctacgttagtttaccgngggactaacgttacccggtaaccgggtaccgtcccgggtaccctaggtaccgtacttacgaggtcggtacgtacggtcgggtcgtacgggacgttacgtacgttcaccgtctaccaaccgtctacgacgcgtaacgccgtagcgtacgtacgtagacgtacggtcgtccggtacttaagtttacgttactacgggtacctacgtaaccttacttaacggttaaccttaacccgtaaccctattcctaaccgttaccgtcccggttaccgtaacgggtaaaccgtaaggtaaccggtaacttaccgtaaacccgtaaacgtacggtacggtacgtacccgg

SEQ ID NO: 59218 - DNA, 664 bp, Homo sapiens
  misc_feature: GYAE6OF02IJ9H2.10.53.E09.1.454.CMB.1.raw
  modified_base (355)..(355): a, c, t, g, unknown or other
  misc_feature (355)..(355): n is a, c, g, or t
  modified_base (389)..(389): a, c, t, g, unknown or other
  misc_feature (389)..(389): n is a, c, g, or t
  modified_base (423)..(423): a, c, t, g, unknown or other
  misc_feature (423)..(423): n is a, c, g, or t
  modified_base (528)..(528): a, c, t, g, unknown or other
  misc_feature (528)..(528): n is a, c, g, or t
tcagcatagtagtgcacgaccggtgctcgatttagagagagtgtgttgggtttggggacaacaggcaggcaggggcagcaagatggtgttggcagacccaggtcttcatttctctgttgctactggatctctggtgccgtacggggacatcgtgatgacccagtcctccagacctccctgcctgtgtctcgtgggcgaggacgggccaaccgtactcaactcgacaacgtccacgccagtacgttgttttatcgagtctaccggaactaaagtaagacttacgttagcttacggtaccagacctaaagaaacccaggaccagtacccttccgtaaagcctgcctactatttacgnggtacagttcccgtaccgggattccccgggtacncggtacctagttcaaggtcgacgacggcgggtcngggaacctagtcctttcaccgtcgtacacctaagtcaacgctacgccgtggacgtaggtactaggaacgtagtcggcgtacgttagtttacgtacttgggtaacncgtaacgtacttaacgtttaaccgtaccgtaccctaatttccgaacgtaccgttcccggtaccgaacgggttaacctaaggtccggaaacgtaaccttacccggaaaccgttctacgggtacgtacctgtaacccg

SEQ ID NO: 59219 - DNA, 852 bp, Homo sapiens
  misc_feature: GYAE6OF02JPGWD.10.53.E09.1.454.CMB.1.raw
  modified_base (178)..(178): a, c, t, g, unknown or other
  misc_feature (178)..(178): n is a, c, g, or t
tcagcatagtagtgcacgaccggtgctcgatttagagagagtgtgttgggtttgggtcgtgagctgggttttcctcgttgctcttttaagagtgtccagtgtcaggtgcagctggtggagtcgtgggggaggcagtggtccagccgtgggaggtccctcagactctcctgttagcctntggattcaccttcagtattatcctttgcacgttgggtccgtacgaggtcctccgagggccgaaggggggctacgggagggtgggggtcgggcctaggtttacgtccttactacgttttggagttgggaaggactaaaattaaagtaccttaacgagacgaaccgttccgggttccggggacccggtaatttccgaaccctacttccttaacccgaaacgtaccgtaaattttacggaaaacgtaaaccgtaacggtccttacggttttcgtacggacctaaaagttacgaaactaaccggtccttaggaaacgacggtaccgttaagggaccggttaaaccgaccgggtaccggttagtttaccggttaacgtttacggtttacggttttaccggttttacggttttccggttagttaccggttacgggttacgggggttaacgttaacccggttcctaaccggtacgtaccggtacggggacccgggacgggtcccggtacccggtaccggtacccgtacccggtccgttaccctccgtaccgtcccgtacccgtaaccgaacccgggacccgtacgtcccggttacccgttcccggtaccggtccctacccgtcccctacccgacgtacccgaccgtacccgttccggtacgggtcccgtaccgtacccggg

SEQ ID NO: 59220 - DNA, 764 bp, Homo sapiens
  misc_feature: GYAE6OF02H3UY6.10.53.E09.1.454.CMB.1.raw
  modified_base (378)..(378): a, c, t, g, unknown or other
  misc_feature (378)..(378): n is a, c, g, or t
  modified_base (621)..(621): a, c, t, g, unknown or other
  misc_feature (621)..(621): n is a, c, g, or t
  modified_base (722)..(722): a, c, t, g, unknown or other
  misc_feature (722)..(722): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatcgacccagtctccagacctcccgtgcctgtcgtcgtcgtcgggcgaggacgggcccaccatacaaccgtgaccaacgtccaggcctaaggtagtttacgtttttactaccgacgtcttaccgaactaaataaacgtaaacttacttagccgtttacggaccagaccaacggaaaccgaggacaccgtcctactaaggctacgtaccttagtaacgttttaccgngggtacctaacgttaccccgggtaaaccccggggtaccgggttcccccggggttaccctacggtaaccccgttacgtttacggaacggggtcgggtaccggtaacgggggtccggggtttaccgggtacggggaaaccgttacggtttaccttttaccgaccgttttaccacccgtaaccctacgtaccgaaccgtacgtacggtcccgacggaccgtaagggtacctaggaacgttaccggnggttacgtacgttagttttactcgctacgacgtactaacttacgtactaaccgtacctacgttacctacgtacgtcccggtaccggaacggaaccgtaggngaactcgtaacgtaacgtacgttcggtactccgtataacccg

SEQ ID NO: 59221 - DNA, 753 bp, Homo sapiens
  misc_feature: GYAE6OF02IF95O.10.53.E09.1.454.CMB.1.raw
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctctatttgatggagacaataaatactacagagactcggttcgggccgattcaccatctaccaaagactaatttagaacgaacacgcgttagttctgacaaagtcgaaacagtacctgagacgtcgtaggtaaggacgacggtctaggtacgttaattaccttacggttttacggttttcggtttacgtcgtaccgtttaccggggtaccgggggtaaaactttacccggtttacacgggtaccgtaccgggtcgggggaccccgtaaggggacccgtaacccggttcggttaccgtaccccggttaccttccccgtaccgtaccgtacccgttacccgaacccggtaacccgggaccctaccggttcccggttacccgtttacccccgtcgggaccccttaccccgtcccttacccgaacggtaccggaacctaccccggttcgggtaccggggccaacccggacgggtcccgggtacccggtcggggtccgttaccggtcccgttaacccgggg

SEQ ID NO: 59222 - DNA, 665 bp, Homo sapiens
  misc_feature: GYAE6OF02I91Q7.10.53.E09.1.454.CMB.1.raw
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (177)..(177): a, c, t, g, unknown or other
  misc_feature (177)..(177): n is a, c, g, or t
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (532)..(532): a, c, t, g, unknown or other
  misc_feature (532)..(532): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagcgtggtttccngttgctntttaagnggtcgtcagtgtcaggtgcagcgtggtggngtcgtgggggaggtcgtggtccagccgtgggacgtccctanagactctccgtagtttacgccttcgtggtacttccacctttgaagttgttaactccttgactacggttgggccgtcacggtcctccggaggtacgagggggctgggacggttgggtagcgtagttactcgtacgttagttcgaaggtaggaactaactaaaagttaactactaacgacggtacggtaccgttccgggttacgggaccgtacttaccactacctactaacctaaagtaactaagttaacggaaacaccgtacgtacttcgttactcgaactaagngaacacgtactaggacgcgtacgtagaacgccgacgtgtagttagttaacgttcggttaaggtttcggtttcggttacgtacggtaccggttacgggtacggttaacttccggttacgacggtaccgtaacgg

SEQ ID NO: 59223 - DNA, 752 bp, Homo sapiens
  misc_feature: GYAE6OF02FPD9Y.10.53.E09.1.454.CMB.1.raw
  modified_base (214)..(214): a, c, t, g, unknown or other
  misc_feature (214)..(214): n is a, c, g, or t
tcagcatagtagtgcacgaccggtgctcgatttagagagagtgtgttgggtttgggctgagctgggtttcctcgttgctcttttaagagatgtccagtgtcagatgcagatggtggagtctgggggaggcgtggtccggccgtggggggtccctgagactctcctgttctgcgtctggattcatctttagtaaatctggcatgtcctgggtccnccgaggttccaggccacgggctgggaatgggtggcagatatacaatagtgatgaactagtaaaatactactagtggatacctaccgttacgaaggggcccgtattaccaccgtataccgtaccaggacaactaacttaccgaaaagaactacgttggtactacttagacgtactaaagtcgaaccgtacgtaccgttacgggaagtacggacccgggtaaaggacccgtaacggggtttcgttttaacgttacgtaggtaacgggaacgtaaacgttccgtaggtcggactacgtacgtaccgttggttacttcgggttacgtaccgggttcccgggaccggtacgggtaaccgggtcggttaccgtacccggttaccgttccgtttaccgacccttacccgtaaccggtaaccgggtcccctacgttccccgggttaccccgtttcccccggtaccggtccccggtcccccgttcgtccccgttaccccggacgggacccgttaccgaccccgggttaccccggaaggtaaccccgg

SEQ ID NO: 59224 - DNA, 905 bp, Homo sapiens
  misc_feature: GYAE6OF02FNPO1.10.53.E09.1.454.CMB.1.raw
tcagcatagtagtgcacgaccggtgctcgatttagagagagtgtgttggggtttggggacaacaggcaggcaggggcagcaagatggtgttgcagacccaggtcttcatttctctgttgctctggatctctggtgcctacggggacatcgtgatcgaccagtctccagacctcctgcctgtcgtctcgtgggcgagacgggccacatacaactgacaacgtccacgaccaggtacgttagtttttacttcgacgtccgttacccgaacaaagtaaacggtaacttacttacgtacgtttcggtaaccaagaccgaaacgaaaacccgacgggaacctaacccggtaccccgttaaccgtaaaacggccgttaccggtaccctttaacgttaaccgtttttaacccggacgggggtacccttaaccgtttacccccgggttaaacccccggggggtaaaccggggttcccccgggggttaccccccgttacgggtaaaccccggttaccgtttacgtaaacggggttccggggaccgtaacggggtccgggggtttaccgtaaccggggggtaactaacggttacgtttttacccgaacccgtttaccgtacctaaccccgtagttacccgaaccgccgtaccggtccgttacgggacctaacggtacgtacggaaacggtcgtaccgggacggttaccttaaacggtttttaactttacggttacgtcggtaactaccgttaacttaacgtttaacgtaacccgttaccctaaacgtttaccgtaaccgttaccggttaccccggtaccgggtaacgggttaaacccaaaggggttaccgtaacggtaaccttaaacggaaaccggttacggttaacgggtaccggttacgtaaccgtaccccgg

SEQ ID NO: 59225 - DNA, 820 bp, Homo sapiens
  misc_feature: GYAE6OF02JAKS9.10.53.E09.1.454.CMB.1.raw
  modified_base (157)..(157): a, c, t, g, unknown or other
  misc_feature (157)..(157): n is a, c, g, or t
  modified_base (189)..(189): a, c, t, g, unknown or other
  misc_feature (189)..(189): n is a, c, g, or t
  modified_base (219)..(219): a, c, t, g, unknown or other
  misc_feature (219)..(219): n is a, c, g, or t
  modified_base (456)..(456): a, c, t, g, unknown or other
  misc_feature (456)..(456): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggagcgtggtccagccgtgggacggtccctnagtactctcctgttagcctctgattcaccttnagtagttatcctttgctacgtcgggtcctnacggctccgaggcgaaggggtctagggaggtggggtcgctagtttactcttacgtagtttggatgggaacgtactaaaattaaacgtacctacgaaggtacgtacgttaccccgggttacggggaccctaaggtttccaaccgtacttaccgtaacccgtaaaagaacgttaaactttaggaaaacgtaacctacggttacttcggttttcaaccggtaacctaaagtacaaaccgngtaaccgtaggaaggtaacgtcgtaacgggaacggtaaccgtaccgggtattcggttaaccttttagtttaccggtttccggttttacggtttacgggtttcttaacggtacccgttacggggttaccgggtaaaccttaccgtacgtacgtacgtaccgggtacgggtacggaccggttacctaccccggcgttacccgtacccgttcctcgtaccgtcggtacccgttacccaaccggtaccgtaccgtaccgttcccggtacccgttccccgtacggtacccctccccgtaacccgtaccgaaccggtacgtaccgttcccgttaccggggacgggacccgtccggtaacccggtcccggg

SEQ ID NO: 59226 - DNA, 666 bp, Homo sapiens
  misc_feature: GYAE6OF02IDJSM.10.53.E09.1.454.CMB.1.raw
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctcagactctcctgtttagcctctggactttcacctttcagttagttatcctttgcctacgttgggtccgtcaggctccaggcaaggggctgggagtggggtgcagttatctcatttgatggagaacaaattaaatactacagacgaccgttccggttacggggccgtaattccaccatcctaccaaagactaattgaaacgaacacgcttgttcngacaaagtgaaccagcctgagacgctaggaggacncggtctggttagtttacgttacgtttgtttcggttttcggttctacggtacgtcgggtacggggtaacttaccgttcacggtctacggtcggggccgacggccgtaccgtacgtccgtacccgtcgtccctaccgcgaccctccgaaccgaaccggccctacgttcccggttacccttcccccggtcgccccgtacccctacccgtaccgaacgtaccgccgtacccgtacccggtggggacccaccggaccggtccccggg

SEQ ID NO: 59227 - DNA, 796 bp, Homo sapiens
  misc_feature: GYAE6OF02IBPMU.10.53.E09.1.454.CMB.1.raw
  modified_base (372)..(372): a, c, t, g, unknown or other
  misc_feature (372)..(372): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatcgacccagtcctccagacctcctgcctgtgtctcgtgggcgagcggcccaccatcaactgacaacgtcccagaccgagtaagttcgtttttaactcacgtcctaccgaacaaattaacgtaacttacgttacgtcgttacggtaacccagaccaacgtaaacccgaagtaaccacgacccccttacgttaacgctcgccgttacttacgtttaccggngggtaccacgttacccgtaacccgggggtaccgtccccggggtccctacggtaccgtacgtttcgaaggttcgggacgtacggccgggttacgtagggaccaggtttaacttccgtacttccacaaccctcaccgtagaccctcgtcctacgggacgtaacggtcgtaaggtaaggccgttagggacccggttactttacggttttaacttacggtcgtaacgtcgtactttaaacccgttaagttaaaccgttacccccgttaaaccctaacgtttaacccgacgttacccccggtttacccgggtaaccccgggttaaccgggaaaacccgttaaggggttaacccggaaggtttaaccccgtaaaccggtaaaaccgggtttccgttaaccggggttacccggacggttacctaaccccgg

SEQ ID NO: 59228 - DNA, 674 bp, Homo sapiens
  misc_feature: GYAE6OF02F42FH.10.53.E09.1.454.CMB.1.raw
  modified_base (323)..(323): a, c, t, g, unknown or other
  misc_feature (323)..(323): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtggttgggtttggggacaacaggcaggcaggggcagcaagatggtgttgcagacccaggtcttcatttctctgttgctctggatctctggtgcctacggggacatcgtgatgacccagtctcctagactccctgcctgtgtctcgtgggcgagacgggccaccatcaactgcaagtccagccagagttgttttactcagtcctccgacaataacgtaactacttagcttggtaccagtacagaaaccaggacagcctactaagctcgctctactttacgngggactagtaccgtaacccgggtaactcccggggtccctagacccgnttccgagttacggcacgggtcggtctacgggactaggtactttcaacttctaccgactactacaacgccgtaacgccttcgacgacggacgtacgaacggattcgggccgtagttaacgtttttacttacgttagtaccgtacgtacctaacgtttaacttacgttaaccgttaaccccctaagttcccgaacttacgttacccgggaccccgttaacggggaaacccttaaagggtaccgggaactaacggttaacccgaaaacggttaaccggttaggttacgggtacccgtaggtaacccc

SEQ ID NO: 59229 - DNA, 691 bp, Homo sapiens
  misc_feature: GYAE6OF02GLMGV.10.53.E09.1.454.CMB.1.raw
  modified_base (351)..(351): a, c, t, g, unknown or other
  misc_feature (351)..(351): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaagtccctcagactctcctgtttagcctctggattcaccttcagtagttatcctttgctactgggtccgtcaggctccaggcaaggggctggagtgggtggctagttatctctattgatggagacaataatactacagagactccggtcgggccgtaattccacctatctaccaaagactaagttgaagaacacgcgttgttcgngtactaaacgtcgaacacggcctaggagagtcgtaggacgggtaaccgacggtcgttggtacgtttaactttaccgtttggtttccggttttggtttcgtacgtacgttccgggtacgggggtaacttacccgtttcgacgtccgtaacgggttcggggcccgtacggggtccctacccggttccggtacccgtacccgttccgtaccctccgaccgtcccgtacccgaacccgacggtccctacgttccggttccccgttccccgtcggtcccctaccccgtccgtaaccgacgaccgccgtacccgtccgggtaccgggctacccgcggtaccccggg

SEQ ID NO: 59230 - DNA, 669 bp, Homo sapiens
  misc_feature: GYAE6OF02F5ZP2.10.53.E09.1.454.CMB.1.raw
  modified_base (490)..(490): a, c, t, g, unknown or other
  misc_feature (490)..(490): n is a, c, g, or t
  modified_base (509)..(509): a, c, t, g, unknown or other
  misc_feature (509)..(509): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcggtgatcgaccctagtcctccagacctccctgcctgtcgtctcgtgggcgaggacgggcccaccatcaactgacaacgtccagccagtagttgttttaatcgagtcctaccgaactaaataaacgtaacttacgttacgtacgttacggtaacccagaccaaacggaaaacccgaacgggtaaccacggtcccctaacccgtaaagtcctcggtacctctaacgttttacgtcgggactacgtaccgtaacccgggtaagtcccgggtcctagaccgtattccgaggtcggacgacgggccggtgtgggactagtacttcaccgtcctacacctacncaacgcacggtcctcggcncgggacagaagcgcgacggtactttaagtttacgtagtcgtacaagtacctattaattaccgtacctaacccgtattaccgacttacggtcccggaccgttaacgggaaacctaggacggtaactaacgtaaacccggaactacggttcggaggtccccc

SEQ ID NO: 59231 - DNA, 649 bp, Homo sapiens
  misc_feature: GYAE6OF02G0NP9.10.53.E09.1.454.CMB.1.raw
  modified_base (337)..(337): a, c, t, g, unknown or other
  misc_feature (337)..(337): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatgacccagtctccagacctccctgcctgtgtctcgtgggcgagacgggccaccatcaactgacaacgtccacgccagtagttgttttactcacgctccgaacaataacgaactacttacgtcttacggtaccagacaacgaaaccgaggacacgcctacgtaacgctacgctactactttacgnggactacgtaccgtaccggtacgtccgggtcctacgaccgtattcgagtcggacgacggtcgggtacgtacgggactagtacttaccacgtcaccactacgtacacgacgacgtccgtcgacgacgtacgtaggaacgtacgtacggcgtacgttaagtttacttacgtcgtactacgtaccttaacgttaacgttacgtaaccgtaccctaacttacctacgttacgttacccggtacccggtaacgggtaacctaagggtacgaacgtaacgtaacggtaaacgtaccggtacggtcggtactacgtacc

SEQ ID NO: 59232 - DNA, 808 bp, Homo sapiens
  misc_feature: GYAE6OF02I7RFN.10.53.E09.1.454.CMB.1.raw
  modified_base (171)..(171): a, c, t, g, unknown or other
  misc_feature (171)..(171): n is a, c, g, or t
  modified_base (190)..(190): a, c, t, g, unknown or other
  misc_feature (190)..(190): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttcgctctggatctcgtggtgccgtacggggacagtcggtgatcgacccgngttctccaacgtcctcccngcctgttcgtctcgtgggcaggacggccaccatacacgtcactaacgtccagccgaggtagtttagtttaactcgacgtcgtaccgaactaacgtaacgtaacctactagtcttacggtacacgacgtaacgaaccgtacggaccgtacgtccctaccgtaaacgtccgtacggtaccttaccgtaacgtttacccggtaggggtacccttaacggttaaccccggttaaccccgggtaaacccggggttcccggggtaacccctacggggtaacccgttaccggttaccgtacgggttacggaccgtacggggtccgggggtacgttaccggggaacttacggtttaacctttccgtaaccgttaccgtacccctaagtaccgacgttacccggcgtaccgttaccggtaacgacggtacggtaacgtacgaaacgggtcgtaccggtacgttaccggtttagtttacgtaccgttactacgtaacaccgttaattaacgttacgtaacccgtaccttagtaccttacggttaccgtcccggttaaccggtacggtaaaccgtaggtaccggttaacgtaaccgttaaccggtaaacgttcggtacgtaccgtaccg

SEQ ID NO: 59233 - DNA, 781 bp, Homo sapiens
  misc_feature: GYAE6OF02JGJDR.10.53.E09.1.454.CMB.1.raw
  modified_base (279)..(279): a, c, t, g, unknown or other
  misc_feature (279)..(279): n is a, c, g, or t
tcagcatagtagtgcacgaccggtgctcgatttagagagagtgtgttgggtttgggctgagctgggtttcctcgttgctctttaagaggtgtccagtgtcaggtgcagctggtggagtctgggggaggcgtgatccagcctggggaggtccctgagactctcctgtttagcctctggattcaccttcaagttagttatcctttgcacgtgggtcctcgaggctccgaggcaaggggctaggaggtgggtgctagttactctactagtttgacgtggaanaactaaagtaaactactacgacgtaagtaccgttccggtaccgggaccgtaattccgaacgtacttacccgaacccgaaaagtaccttaaaagtttacggaaacggtaaacctaccgtacttacgtttactacggtaactaaaagtacgaaaccgacgtaccgtaggaacgacgtcgtacgaacggtacgacggtcttaggtacgttaacgttaacgtttggtttacggtttacggttacgtacggtacggttacggggtaccggggttaacttaccgtactacggtaccgtacgggtaccgggacggtaccgggtaccctaccgggttacgtacccggtacccgttaccgtcccgttacgacccggtccccgtaacgacccgtaaccgggtacctacccggttaccgtccccgtaccccggtggaccccgttacccgtaaccctaccggaacgttcccgaccgtaacccggttccgggtacgggacccacggtacccgggg

SEQ ID NO: 59234 - DNA, 665 bp, Homo sapiens
  misc_feature: GYAE6OF02FW1I9.10.53.E09.1.454.CMB.1.raw
tcagcatagtagtgcacgaccggtgctcgatttagagagagtgtgttggtttggggagctacaacaggcaggcaggggccagcgaagatggtgttgcagacccaggtcttcatttctctggttgctctcggatctctgggtgcctaacggggacatcgtgatgaccctagtcctccagactccctgcctgtcgtctcgtgggcgagacggccaccgatcaactgacacgtccagtccagtgttgttttatcagtcctcgactaaataagacttacttagcttaggtacccagccaagaaaccaggacacgcctacctaagtctgacgtctactttactgggctatccggtacccggtaatccccgggtcctaggtacccagttccgaggtcggtacaggtccggtcgtacgggactggtaactttccgaccttcgtaaccaaccgtacgtccacgaccgtacgcccgttgaaccgtacgggtcctaagggtaacgtacgttaccggccgtacgttaacgtttacgttacgtcgttaccagtacctaacgttaacttactaccgtaaccctagttaccgaccgttacgttcccggtacccggttaacggaacccgtaaaggtccgaaacgtaccgtaaaccgaaacgtaccgttaggccgtaaccg

SEQ ID NO: 59235 - DNA, 840 bp, Homo sapiens
  misc_feature: GYAE6OF02G06JZ.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatcgacccagtctccagacctcctgcctgtcgtctcgtggcgagacgggccaccatcaactgctaacgtccacgaccagtagtttagttttactccagtcctacccgaataaacgttaaacgaaaccttacgtaagtccgttacggtaaccaagacaaacggaaaccgaggaaccacgtaccctacctaagtcctgtaccttacttaacgtttacgcgggtactaaccgttacccggttaaccccggggtaaccgttccccggggtaccctacggtacccgtactttcggaacggtcgggtacgacgggtccggggtcggacgggtaacgtagtacttttccgaaccttccgtaccaacccgtacgtaccgtaacgtaccgaccgtacccgtacggaccggtacggtacgtaacggtaaacgtacggttaccggtaccgggttaccgtttaaacggttttactttaaccgttccggttaaccgtacgtaaacccttaaacgtttaaccgtttaaacgttaaccccgttaaacccttaaactttacccgttaaccgtttaccggttaccccgggtaacccggttaacgggtaaacccggttaacgggtaaacgggtaacgtttaaaccggtaaacccggttaaaccgggtaacggttaacccggtacgggtacccttacggtaaccccg

SEQ ID NO: 59236 - DNA, 824 bp, Homo sapiens
  misc_feature: GYAE6OF02FWK7H.10.53.E09.1.454.CMB.1.raw
  modified_base (637)..(637): a, c, t, g, unknown or other
  misc_feature (637)..(637): n is a, c, g, or t
tcagcatagtagtgcacgaccggtgctcgatttagagagagtgtgttggggtttggggggagctacaacaggcaggcaggggcaggcaagatggtgttgcagacccaggtcttcatttctctgttgctctggatcctctggtgaccgtacggggactatcgtgacgtagacccagtcctccatacctccctgcctgttcgtctcgtgggcgagacgggccacactacaactcgactaacgtaccacgaccagtacggtttgtttttaacttcgacggtaccgtaccgaaaactaaaacgttaaaacgaaaaccggttaaccttttaaggtaccccggttttacgggtaaccaaacggtaaccgtaaacgggaaaaaacccgacggggaacctaaccggtccccttaaccggtaacgtccgtacgtacctttacgttaacgtttacggtcgggacccttaacgttacccggtaaccggggtaaccggttccgggttaccctacggtaaccgtacttcgtaggcggtacgtacgggtcccgggtagtcggggtaaactcgttaaccgttctaaccttccggtaccaccgtaatccgagaccgtacgccgtacgccggtaggtacgaaggacgtaacggngtaccgttagtttacgtttaactacgttcgtaccgtacgttaagtaacctttaactaacggtaacccctaccgtttaatacccggttaacgtccggttaccccgggacggttaacccgggtaaacgttaaacgggcgggtaaatacccgtaaaacccgggaaactacggttccggacttaacccggg

SEQ ID NO: 59237 - DNA, 898 bp, Homo sapiens
  misc_feature: GYAE6OF02HOA1Q.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtcgcccgtacggggacagtcgtgatcgacccctagtcctccacgacctccctgcctgtcgtctcgtgggcgaggacgggcccaccactacaacgtgaccaacgtccacgacccgtaagtaggtttgtttttactccgacggtccttaccggaaactaaaacttaaacggtaaaccttaaccgtttaacggtacccgtttacgggttaacccaggaacccaaaacggaaaacccgaacggaaccctaacggtcccccttaaccgtaaacgtccgtcgtaccttaaccgttagttttaccggtacgggaccttacgttacccggtaacccccggggtaacggttcccccggggtacccgtacggtaacccgttagttaccggaggtcgggacgtacggggtccgggttaccggtagggtaaccgtaagttacctttaccgaccgttacccgtacacccttacgtacgacggtccgaccgtccgtaggaccggtacgtacgtaggaacggtagacgggtccgtaagtttacggtttaacgtttccgtacggtaccgtaacgtaccgtaaacgtttaacgttttaacctaaacccggttaaccccgttaactttacccgtaaccggttaccccggtttaacccgggtacccccgggttaaagggttaaccccggtaaaagggttacccgggttaacgtaaaccggtaaacccgttaaacccggggttaagggttaccccggtaacggggtttacccaccggttaaccccc

SEQ ID NO: 59238 - DNA, 894 bp, Homo sapiens
  misc_feature: GYAE6OF02GF28U.10.53.E09.1.454.CMB.1.raw
  modified_base (378)..(378): a, c, t, g, unknown or other
  misc_feature (378)..(378): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggagtcgtgggggagcgtggtccagccgtggggacggtccctagacgtactccttccgttgtttacgccttcgtggtactttccgacctttcaaggttagttacttcctttgctaccgttgggttccgtcgaggtccgtccgaggccgaaggggcgtgggtaggtggggngtcgtaggttactcgttacgtagttttggaaggttggaaacgtaaacgtaaaattaaattaaccgtaacgtaagggtaacgacccggttttacccgggtttaccgggggaccgttaacgtttacccgtaaccgtaaccttcccgtaaaccggtaaaaccgtaaacgttaaacgtttaaacgggaaaacgtaaacccggtaaacccggttccgttttaacggttttaccgtacggttaaaccgtaaaacgttacggaaacccgtaggtacccgtaagggtaacgtaacgggtaccggtaaacgggtaaccgggtaaccggtaacgggttacccggtttacgggtttaccgtttaacgtttttaaccggtttcgggtttttaacccgggtttttcggggttttaccccgtttagggttaacccccggggttttacgggggtttaaccccggggggtttaaacccgttttaaccccggttttacccggaaccgggtttaccccgggttaaacccggggg

SEQ ID NO: 59239 - DNA, 181 bp, Homo sapiens
  misc_feature: GYAE6OF02H3ZMH.10.53.E09.1.454.CMB.1.raw
  modified_base (172)..(181): a, c, t, g, unknown or other
  misc_feature (172)..(181): n is a, c, g, or t
tcagcatagtagtgcacgaccggtgctcgatttagagagagtgtgttgggtttgggggaagaggaagactgacggtccccccaggagttcaggtgctgggcacagcggccctgggctgcctggtcaaggactacttcccatactatgctgagcgggctggcaggcgcatagnnnnnnnnnn

SEQ ID NO: 59240 - DNA, 700 bp, Homo sapiens
  misc_feature: GYAE6OF02JHT3H.10.53.E09.1.454.CMB.1.raw
  modified_base (632)..(632): a, c, t, g, unknown or other
  misc_feature (632)..(632): n is a, c, g, or t
  modified_base (672)..(672): a, c, t, g, unknown or other
  misc_feature (672)..(672): n is a, c, g, or t
  modified_base (679)..(679): a, c, t, g, unknown or other
  misc_feature (679)..(679): n is a, c, g, or t
tcagcatagtagtgcacgaccggtgctcgatttagagagagtgtgttgggtttggggacaacaggcaggcaggggcagcaaggatggtgttgcagacccaggtcttcattctctgttgcttctggatctctggtgccgtacgggactactcgtgactcgacccagttccaccagtacctccctggacctgtcgtctcgtcggacggacgacgggtcccaccgtaatccaacgtagacgtaacgtccacgcctagtagttgttttaacttcgacgtcctccgaactaattaaacgacgtacttagaccgttaggaaccacgtcaaaccgtaaaccgaggaccaccggaccttacgtaacgaccgtgtccctagtaaccgttttacggtacggtacaccgttacccggtacccgggggtaacgtccccggggttaccttaccggacccttacgtaccgtaacggtgaccggtaacggtccgggtaacgtacgggacacgttaactttcccgaccctttcgtaccctacgtaacgtccacggtactaaccgtcgtacggaccgcggtacctagtaacgcgtcggtaccgacttagttacttcgtacgaccgtgtaaccctaagtactacgttacncctacactcgtacgtccgaccgtacggtacgacggttcanaccgtanaaccgtgactaggtcacgacc

SEQ ID NO: 59241 - DNA, 719 bp, Homo sapiens
  misc_feature: GYAE6OF02G36DU.10.53.E09.1.454.CMB.1.raw
  modified_base (156)..(156): a, c, t, g, unknown or other
  misc_feature (156)..(156): n is a, c, g, or t
  modified_base (273)..(273): a, c, t, g, unknown or other
  misc_feature (273)..(273): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagcctgggaggtccctnagactctcctgtttacgccttctggacttcacctttcagttagttatcctttgctacgtgggtccgtcaggcctccgaggcgaaggggctgggaggtggggtggactagttactctntatttgatggagacaaataaaatactaacagagactccggttcgggccgattccaccgatctaccaaagactaatttagaagaacacgcttgtttcngacaatagaaacgacgcctagaagtagctaggaacggaccgacggacttggtagttaacgtttacgttgttttcggtttgggtttctcggtaccggttacgggtacggggtaaaccttaccgtacacgccgtacgtcgggggaccgacggggtacctacccggttcggtacccgtacccggtcccttcccgtaccgaccgttccctaccccggaaccgaaccgggtccccgtacgttcccgttaccccgtttccccggtcggtccccctaccccttaccccggtaaccaacggtacccgacccgtacccggtccgggtacccggggacctaccggaccggtaccccggg

SEQ ID NO: 59242 - DNA, 734 bp, Homo sapiens
  misc_feature: GYAE6OF02HBD31.10.53.E09.1.454.CMB.1.raw
  modified_base (267)..(267): a, c, t, g, unknown or other
  misc_feature (267)..(267): n is a, c, g, or t
  modified_base (327)..(327): a, c, t, g, unknown or other
  misc_feature (327)..(327): n is a, c, g, or t
  modified_base (398)..(398): a, c, t, g, unknown or other
  misc_feature (398)..(398): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctcgtggtgccgtacggggacagtcgtgatcggaccctaggtctccagtacctcctcgccttggtgtccgtctggggacgacgggaacgggtcccaactacacgaagtgaccgtaagcccgacaccgtaagtacggttttnttttacaccgcggctacccgaaataacgtaaacgtaaaccttgtataccggttagacganacgtaaacgaaaccgacggtaacgaccgtacctacctaaacgcgtacctcttaacgtaacgttttaccggnggtacctaccggttaccccgggttaaccgggtacgggtaccccggggttacctaacccggtacgttaactaccggtggtaccggacggtacggggtccgggttacgtacggtataacggttcttaccacgtaccgacctacgactacgacgacgacncgtcgagngacgtacggacgtcggtacgtcgtattacgtacgttcgtagactacgtactaaccttagttaaccttaccgtcacgttacctaccgtaccggtaccggtaccggtaacggaaccggtaaggtacgtaaccgtaacgtaacggtacggtaagtaccggtctacgtacgtacc

SEQ ID NO: 59243 - DNA, 632 bp, Homo sapiens
  misc_feature: GYAE6OF02I39MD.10.53.E09.1.454.CMB.1.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
  modified_base (566)..(566): a, c, t, g, unknown or other
  misc_feature (566)..(566): n is a, c, g, or t
tcagcatagtagtgcacgaccggtgctcgatttagagagagtgtgttgggtttggggacaacaggcaggcaggggcagcaagatggtgttgcagacccaggtcttcatttctctgttgctctggatctcgtggtgccgtacggggacagtcgtagatcgacccagtcctaccagacctccctcgcctgtcgtctcggtggacgaggacggccacatacaacngccaaaggtcccaaggcccagtagtgttttaatcaagctaccggacaataagaactacttaacgnttggtaccagcagaaaccagacagcctcaagctgctcattactgggacatcgtaccggaatccgggtacctgaccgattcagtggacaggcggtactgggacagtactttacactctacaccgactacgacgacgacgaccgtacgacgaacggacgtacggaacgtaacgtacgacgttacgtaacggtttaactaacgttacgttacgaacgtaaccgtaacgttaactaaggttaaaccccgtaaaccgtaacgttacccgaacttaccggttaanccgtaccggtaaccggtaaccgtaacggtacggtaacgtaaccgtaacgtaacgtacgtaggtacg

SEQ ID NO: 59244 - DNA, 894 bp, Homo sapiens
  misc_feature: GYAE6OF02HP56C.10.53.E09.1.454.CMB.1.raw
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
tcagcatagtagtgcacgaccggtgctcgatttagagagagtgtgttggggtttggggacaacaggcaggcaggggcagcaagatggtgttgcagacccaggtcttcatttctctgttgctctggatctcgtggtgccgtacggggacatcgtgagtcgacccagtcctccacgtacctcctcgcctgtcgtcgtcgtcgggcggaggacgggccaccnctacaacngcaacgtccacgaccaggtagttagttttactcgacggtacctaccgtaaacgtaaaactaaacggtaaacctttaacgttaacgtccgttttaaccggttaaacccgaacggaaccgaaaacggtaaaaccccgaaacgggtaaccaaccggtaccccctaaccgttaaaaccggcgttaccgtaccgtttaaccttaaccggtttaaccggtgggtaccctaacggttacccgggtaaaccccggggtaaccgggttcccccggggtacccgtacggtaaccctacgtttaccgacggggtcggtaacggtacgggccggggttacgtacggggaaccttaggttaccgtttaccgaccctttaccgtaccaaacccgtaactaccggaacggactaccggtacgtaccgggacgtaccggtacgtaggaaacctacgggtcggtaccggttaacttaacggtttttataccggttaacgggttaacttacgtaaaccgtttaaacttaacccggttaacccgtaaaccctttataacccgtaacgttcccgttaccccgggttaccgtaaccgggtaaaccggtaacggttaaggtaacccgtaaacttaaaccccgaacggttacggttaacccggtggtaacccttcggaaccccttaacgg

SEQ ID NO: 59245 - DNA, 777 bp, Homo sapiens
  misc_feature: GYAE6OF02HN1O6.10.53.E09.1.454.CMB.1.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacagtcgtgatgacccagtctccagacctcccgtgcctgtcgtctcgtgggcgaggacgggcctacatcaacgtgacctaagtccacgaccaggtacgttgttttaactcgacgtaccttacccgaactaaagtaaacgtaaacttaactttacgtaccgtttacgggtaacccaacggtaccaaacggtaaaaacccgagggaaaccgtaacgtaccccgttaccgtaaaacggccttacggtaccttacttaacgttttaccggtagggtacctaaccgttaccggtaaaccccggggaacgtttcccccgggggtacctacggggtaaccgtacgttacgaacggtcggaccgtagggccgggtttacgacggggactacgtactttacaccgttactaccgactagtcacgtacacggtcctagcggtacgtacgtacgaagtcgcgtacggtactttaagtttacgttagtacgttacgacgtaccttaattacgttaaacgtacccgttaaccgttattaccgtacgttacggttacccggaccggttaacggtaaccggtaacggtaacggtacgttaaacgtaaccggaaaccggtttacgtaccgggttagtaacccgg

SEQ ID NO: 59246 - DNA, 801 bp, Homo sapiens
  misc_feature: GYAE6OF02IF5V2.10.53.E09.1.454.CMB.1.raw
  modified_base (402)..(402): a, c, t, g, unknown or other
  misc_feature (402)..(402): n is a, c, g, or t
  modified_base (692)..(692): a, c, t, g, unknown or other
  misc_feature (692)..(692): n is a, c, g, or t
tcagcatagtagtgcacgaccggtgctcgatttagagagagtgtgttgggtttgggacaacaggcaggcaggggcagcaagatggtgttgcagacccaggtcttcatttctctgttgctctggatctctggtcgccgtacggggactatcgtgactcgaccctagtctaccgacgtacctcccgtgtcctgtcgtctcgtgggcgaggacggccacgatacaacgtcgacaacgtccaagaccgaagtacgttagttttactcgacgtactaccgaaataaacgtaaacgtaaccttagttacgtcgttacggtaacacggtaacaaacggaaaccgtacggaacctaccggtacccttaaccgtacggtacctacgtaccgttaaccttacgttttacggngggaaccttacgtacccggtaaaccggggtaccggttcccgggtaccacgtaaccgtactcgggtaacgtcggactacggggtacggtcgtaagggacctaggtttacctttaccgaccttaccgaccctacgtaaccgttccgaacgaccgtcggtaacctacggaccggtaaggtccgtaaaggttaaaccggcggttaacgttaccggtaacgtttaacgttttaacgtaccgttaccgtaacgtaccgtacgttaaaccgtaacttacttaacccgtacccgttanaaccgtaccgttacggtcccggttaaccgggtaacgtaaagtacgggtaaccgttaagtaacccgttaacgaaacccgttgggtagtaaccggtcctaccgtaacccgg

SEQ ID NO: 59247 - DNA, 843 bp, Homo sapiens
  misc_feature: GYAE6OF02H41FL.10.53.E09.1.454.CMB.1.raw
  modified_base (503)..(503): a, c, t, g, unknown or other
  misc_feature (503)..(503): n is a, c, g, or t
tcagcatagtagtgcacgaccggtgctcgatttagagagagtgtgttgggtttgggacaacaggcaggcaggggcagcaagatggtgttgcagacccaggtcttcatttctcttgtttgctctggatctctggtgcctacgggacatccgtgatcgacccagtccgtccagtacctccctgccctgtcgtctcgtcgggtacgagacgggcccaaacccgtagtaccgaaaccgttcgaccgtaacggttcccaagtaccccgtaaggtacctttgggtttttaccttaccgacggtacctttccccggaaactaaaattaaacgtaaaacccttacgttaacgtccgtttcggttaacccccgaagtacctaaaccggaaaacccgtaacgggtaacccgaacggtaccccgtttaacccgtaacgaccttacgggtacttaacctacgttttaaccggtggacctaacgtccgtaacccgggtacgttccccgggttaccncggtaaccgtctttagtacggtacgggtacctacggggtacggttcgtaacggggtacctaacggtttctttaccggacctttaccgtaccctaaccggtacctaaccggaacgtacccgaacggttacccgtgtaccgtaccgggtacgtaacggtacgtacgtacgggttccgtaacgtttcgtttaaccttagttaccgtaccggtaccgtaacgtacgtttagtaacctttacggacccttagttccgttactacggttaccggtaccgtacggtaaccgtagtaccggtaactacgttacgaacgttaaccgtaggtacggtaccgtcgtaaccg

SEQ ID NO: 59248 - DNA, 742 bp, Homo sapiens
  misc_feature: GYAE6OF02GHWEQ.10.53.E09.1.454.CMB.1.raw
  modified_base (170)..(170): a, c, t, g, unknown or other
  misc_feature (170)..(170): n is a, c, g, or t
  modified_base (326)..(326): a, c, t, g, unknown or other
  misc_feature (326)..(326): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctgtggatctctgtcgccgtacgggacatcgtgatcgacctagtccncacgcctcctcgcctgtcgtctcggtgggcgaggacggaccaccactacaacgtgacaacgtccacgccaggtagttacttttatacgcgtaccctaccgaactaaagtaacgtaactacgttacgtcttaggaccagacgaaacgaaccaggacncgtaccgtacgtaacgtctcggaccttctaacgtttacggacggtactaacgtaccggtaacccggggtaccggttcccgggtacccgtacccgtaaccgttacgttaccgtacgggtacggacgtcggggtaccgggtacggtacgggtaacttcgttaacgtttacccgtacccgtacctaccaaccgttctaacggtaccgtaccgtacggcccgtacggacggtaacggttcgacggtaaacgtcggacggttacgttacggttaagttttacggtacgtagttaccagttacctaagttacgttaaccgtaccgtaccttacgttacctcggtaccgtaccggttaccgaacgggaaccttaagggaccgtaagtacccgtaaccggtaacgtacggtacgtcggtaaccg

SEQ ID NO: 59249 - DNA, 798 bp, Homo sapiens
  misc_feature: GYAE6OF02FM51R.10.53.E09.1.454.CMB.1.raw
  modified_base (251)..(251): a, c, t, g, unknown or other
  misc_feature (251)..(251): n is a, c, g, or t
tcagcatagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgcttacttttaagaggtgtccagtgtcaggtgcagcgtggtggagtcgtgggggagcgtgtccagtccgtggggacgtccctnacgaccttctccgtgtttacgccttgtcggtactttaccacctttcgtagttacgtttacttccgttttgaccgtacgttcggggtcccgtcgtaacgggtcctacccggaggtaccggaaagggggtcgtaggggtacggttgggggtcggtacgtaagtttacgtccttacgtaacgttttggagttaggaacggtaactaaaacgttaaaactaaccgtaagaacggtaaccggtaccggtttacccggggtttaccgggtacccgtacgtttacccgaacccttactaccccgttaacctaaaaaccggtacttaaacggttacggaaaaccgaaccgtaacggttcctttacggtttcgtaacgtaacctaaacgttaccggaaaccaccggtacctaggtacgaacggtcgtaagtacggaaccgtaccggtagtttcgtacgtttaccgttacggtttccggttttcggtttacgttccgttacggttaacggttccgggttacggttaaccgtaccgttcggtacgtacggtacccggg

SEQ ID NO: 59250 - DNA, 827 bp, Homo sapiens
  misc_feature: GYAE6OF02JKN2N.10.53.E09.1.454.CMB.1.raw
  modified_base (168)..(168): a, c, t, g, unknown or other
  misc_feature (168)..(168): n is a, c, g, or t
  modified_base (670)..(670): a, c, t, g, unknown or other
  misc_feature (670)..(670): n is a, c, g, or t
tcagcatagtagtgcacgaccggtgctcgatttagagagagtgtgttgggtttggggctctgggagacgagcccagcactggaagtcgccggtgtttccattcggtgatcatcactgaacacagagactcacagtggagtttggctaggagtcgttgggtttttcccngttacgcctttacgttttaaaggcgggttcgtccgaaggttcgtaccgaagggttcaccaggtccgttagggtaggacggttcgggtagggggacgtccggttggtcccgagtcccggtggggaaccgtcccctagaacggtaccttcgtccgttagtttaccgccgttcgtggtaacttccgtaaccgttctacggttaacgttacttaccgtttcgacgtacggttccgggtaccgtacgtaacggccttacggacgggtaccggtaacgggtcgtagggtcggttaacgggtcgtaccgttagttactcgttactagtttcgaacgttgggaaactaactaaacgtaaacgttacgacgtaacggtaccgtaaaccggttcccggggttaacgggcccgttacttaacccaaccggttactaaccgtaaaccgtaaacgtagttaacgttaacaaaaccggtacttaccggttactttgttacgtaacgaacgttaaanacgtaacctcggtactaagagtaacgtcgtaacgaaggacccgtaaggtcttacggttacttaacgtttccggtttcggtttaccgtttggtcccgtaaggttaccgggtaacggggttaccgttaaaccgtacttccggtacggccgttaaccggg

SEQ ID NO: 59251 - DNA, 662 bp, Homo sapiens
  misc_feature: GYAE6OF02HR0Y6.10.53.E09.1.454.CMB.1.raw
  modified_base (351)..(351): a, c, t, g, unknown or other
  misc_feature (351)..(351): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtgtctcgtgggcgaggacgggcccacataccaactgacaacgtccagccagtagttgtttatcgagcctaccgaacaaataacgaactacgttagtcttaggtaccagaccaacgaaaccgaggaaccacgtccctaccgtaagctacggcctactagtttacgngggctagtccgtaacccgggaacgttcccgggtccctagaccgtattcgaggtcggcgaggccggtgtgggactagtacttcactccgtacacctatacgacgcacgccgtacggacgtacgtcgtacgaagtcgcggaccgtacgttaatttacgttactcggactacggtactaacttattaaccgtaacccgttaacccttattacccgtaacgttcccgtacccgggtaccccgtaaagggaacccgttaagggttacggaacgtaacggttaaacccgaaccggtaacggttacggtcggtaaccg

SEQ ID NO: 59252 - DNA, 563 bp, Homo sapiens
  misc_feature: GYAE6OF02INM6T.10.53.E09.1.454.CMB.1.raw
  modified_base (346)..(346): a, c, t, g, unknown or other
  misc_feature (346)..(346): n is a, c, g, or t
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (551)..(551): a, c, t, g, unknown or other
  misc_feature (551)..(551): n is a, c, g, or t
tcagcatagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggaggtgggtggcagttatctctattgatggagacaataaatactacagagactcgttcgggccattcaccatctaccaaagactaatttagaaagaacacgcttgtttcngacaaatgaaacagcctgagagctgacgacacggctgtgtacttacgtgttcgtttgtctgtactcggtcggggatctcagcacgtgggacaggcctacctcggtcnccgtctcctcncgcctccaacgaccggtacccagtccggttccttcccccgcgccctacccctcctaccacgaccgcctaccgtccgtacggggaccncggacgcccggg

SEQ ID NO: 59253 - DNA, 770 bp, Homo sapiens
  misc_feature: GYAE6OF02JO2UZ.10.53.E09.1.454.CMB.1.raw
  modified_base (126)..(126): a, c, t, g, unknown or other
  misc_feature (126)..(126): n is a, c, g, or t
  modified_base (523)..(523): a, c, t, g, unknown or other
  misc_feature (523)..(523): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctntggatctctggtgccgtaacggggacatcgtgatcgaccagtcctccagcctcccctgcctgtgtactcgtgggacgaggacgggccctaccactacactaggacacgtccacgaccaggtacgtttagttttacttcgacgtaccgtaccgtaaactaaacgtaaaacgtaaccttaacgttaaccggtccgttaaccggttaaccgaacgtaccgaaaaccggtaaaccgaacggtaaccaccgtaccctaccgtaaagtccgtagtacctacttaacgttaccgtaggtacctaaccgtaccggtaacccggggtacgttcccgggtacctacggaccgtacgttacgacggtcggacgtcgggtacggtacgtacggactacgttacttaccncgtcctaacaccgtacgtacgcgtacgtacgtccgcggaacgtcggtaacgtaggtaacgttcggacgtacggtttaacgttagttttaccgtaacctacggtactaaccgtaccttacggtttaaactacccgttaacccggacctttactacgggtaccctccgggtttaacccgaccggtaaacgtacggaaacgggttcaaccgtaaaccgtaacggtaacgtaaccggttgggcctaaccgg

SEQ ID NO: 59254 - DNA, 862 bp, Homo sapiens
  misc_feature: GYAE6OF02JDJ6I.10.53.E09.1.454.CMB.1.raw
tcagcatagtagtgcacgaccggtgctcgatttagagagagtgtgttgggtttgggctgagctgggttttcctcgttgctcttttaagaggtgtccagtgtcaggtgcagctggtggagtcgtgggggaggcgtggtccagccgtgggacggtccctcagactctcctagtttagcctcgtggtattccaccttcgagttagttattcctttgctacgtcgggtccgtcgacggctccgagggcgaacggggctagggacggttgggggtcggtccaggtttactctctagtttcgaagtggaagactaaagtaaactacgtacgagacgaccgttaccggtccggggacctacttaccgacctactaccgtaaccgaaaacgtaactaaagtttacgaacgtaaccgtaaccggtctttcgtttaccgaacgtactaaacgtacgtaacgtacgtaccgtaggaacggtacggtcggttaacgggacgggtaacccgaccggggtcgtttacggtaacgtttaacgttttaccggtttacggtttttacgggttttcgggtttaccgtttacggtaccggttcccgggggttaacgggtaacccttaccgttaccgaccgtaccggttaccgggtccggggtaccggtaccgggtacccgtcccggtaccggttacccgacccgttacctcccgtaccgtaccgtacccgtacccgaacccggtaaacccggtcccgtaccgtccccgggttaccccttaccccggtcccggtacccgtacccgttaacccgtccgtaaccgtacccgtacccgttacccggtccgggttacggggacccctaccgggtaccggtccccgg

SEQ ID NO: 59255 - DNA, 896 bp, Homo sapiens
  misc_feature: GYAE6OF02HC7WY.10.53.E09.1.454.CMB.1.raw
  modified_base (156)..(156): a, c, t, g, unknown or other
  misc_feature (156)..(156): n is a, c, g, or t
tcagcatagtagtgcacgaccggtgctcgatttagagagagtgtgttgggtttgggctgagctgggtttcctcgttgctctttaagaggtgtccagtgtcaggtgcagctggtggagtctgggggaggcgtggtccagccgtggggacggtccctnagacttctcctgttagcctctggtattccaccttcagttagtttacttcctttgcctacgttcggggtcccgtcgacggcctccgaagggcgaaacggggggtctagggacggttggggtcggctaggttctcctactagtttggacgtggaacgaacgtaaactaaagttactacgagtaacgtaccgtccggttacggggcccgtaacttcgacctactacctaccaaaaggtactaaacgtttacgaaacggtaacctacggtcccgtttaggttttacctacgaacgtaaaaagtacggtaaacccgtacgtacccgtacgggtaacgaacggtacggtttacggaacgggtaacccgcgggttaccgttgttaacgggtttaacctttaaccggtttccgggtttttccggttttacggtttaaccgtttcggtaccggtttaccggggtaacgggggttaaccttacccggttaccgacggtccgaaccgggttccggggaccgtacggggtaccctaacccggtccggtacccgtccccgttaccgtaccctcccggtaaccgttcccgtaacccgtaacggtaccccggacccgttaccgtttaccccgggttccccgtttccccggttacccggtcccgtaccccctttacccgtaacccgtaacggtacccgacccggttccgaaccccggggttccggggtaacctaccgggacccgggtacccccggg

SEQ ID NO: 59256 - DNA, 842 bp, Homo sapiens
  misc_feature: GYAE6OF02FH4J9.10.53.E09.1.454.CMB.1.raw
tcagcatagtagtgcacgaccggtgctcgatttagagagagtgtggttggggtttgggggagctacaacaggcaggcaggggcagcaagatggtgttgcagacccaggtcttcatttctctgttgctctggatctctggtcgaccgtacggggacatcgtagatcgacccagtctccacgacctccgtgcctgtgtcctcgtgggcgagacggccaccatccaactgacgacgtccacgccaggtacgttattttactcgacgtcctaccgaactaacgtaacgtaaccttacttaaggtcctttacgggtaacctacggaccgtaacaaaacccgtaggggaaccaccgtccctaccgaaacgtcgtacgtaccttacctaacggttttaacgccgggtactacgttacccgtaaccccggggtacgttccccgggggtacccctacggtacccggtaactttacggacggttacggctacggggtaccggggttacggttaccggaacggtaacgtacgtttaccgaccttaccgtacctacccgtaacgttcccgaacggccgaaccgtcccggttacggaacccgtacggggttccgtaacggtaaaggtccggttaacgggacccgtttcggttaaacgtttttaaaccgtaccggttaccggttaacgaacgttcccgttaaacgtacctttaaaccggtacccgttaaacccgtccgtttacccaacggttacccggttacccgggaccccggttaacgggtaaaccgttaacgggtaccggaacgttacccgtaaacccgtaaacggaacccggtttaggacccggttaacccg

SEQ ID NO: 59257 - DNA, 795 bp, Homo sapiens
  misc_feature: GYAE6OF02HBR5Q.10.53.E09.1.454.CMB.1.raw
tcagcatagtagtgcacgaccggtgctcgatttagagagagtgtgttgggtttggggacaacaggcaggcaggggcagcaagatggtgttgcagacccaggtcttcatttctctgttgctctggatctctggtgccgtacggggacatcgtgatcgacccagtcctccagacctccctgcctgtcgtctcgtgggcaggacggccaccatacaactgacaagtccagccaagtgttgttttatcgagtcctacgaactaaataagtaaccttacttacgtcgttacggtaaccagaccaacgaaaccaggaaccacggtacccctaccgtaacgctacgtcctacttacgtttacgcggacctacgtacccggtaaccccggggtaccggttccccggggttacctaccggtaaccgtactttcgaacgggtccgggaccgtacgggtccgggtacgtacggggactaacggttactttccgaaccttccgtaccctaacccgtaacgtccgaacgccgtaccgtccgtcgaccggtacggtacgtaacggaaacgttacggtccgggtaaccgttaacgtttaacgtttaaccgtttacgttacggtaccgtaacgtaccttaaacgtttaactttaaccgtaaccccgtttaaacccttaactttacccgtaaccggttacgtttacccccggaaccgggttaaccgggaaaccgttaaacgggttacgggaaaccgtaaccgttaaacccggaacgggttaaccttaggggtccgtacggtacccgtacccg

SEQ ID NO: 59258 - DNA, 566 bp, Homo sapiens
  misc_feature: GYAE6OF01CH6M8.26.57.F02.1.454.CMB.1.raw
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtagctatttaaaagtgtcagtgtcaggtgcagctggtggagtccgggggaggcttggtccaggccggggggtcctgaaactctcatgtgcaggctctggattcacattcagtgactcggctatatactggggtccncagtctgccggaaaggctggagtggcttggccgtattagaacaaacctgacaagtacgcganaatttangctgcgtggngcaggcagtcacntctacgagagtatagtatacagaagaacgacggacgtacgtactacgacaataacgaacgaacgaccgtaacgaaacgaacggacgacggacgtacgtacgttacgtacgtcgtacgacgactacgtaccgttacgttaacgtttaacgtttaagtttttacgttagtcggtaccg

SEQ ID NO: 59259 - DNA, 177 bp, Homo sapiens
  misc_feature: GYAE6OF01CGO3F.26.57.F02.1.454.CMB.1.raw
  modified_base (170)..(177): a, c, t, g, unknown or other
  misc_feature (170)..(177): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttgggctgagcgggctggcaaggcgcatagnnnnnnnn

SEQ ID NO: 59260 - DNA, 560 bp, Homo sapiens
  misc_feature: GYAE6OF01DXOBN.26.57.F02.1.454.CMB.1.raw
  modified_base (371)..(371): a, c, t, g, unknown or other
  misc_feature (371)..(371): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtaggctatttaaagtgtcagtgtcaggtgcagctggtggagtccgggggaggcttggtccagccggggggtccctgaaactctcatgtgcaggctctggattcacattcagtgactcggctatatactgggtccgccagtctgccgggaaagggctggagtggcttggccgtattagaaccaaacctgacaagtacgcgacaattttangctgcgtcggtgacgaaggcgtaggttcacctactcctaccagagatgtattcgagagaacgacggacgtactctagacaaatagaacgacgtaccgtaacgaaaccgacggaccgaccggtccgtagtacttacgtgtcgacagacacgtccgtacgttactttacgttatttttctagttcggtccg

SEQ ID NO: 59261 - DNA, 516 bp, Homo sapiens
  misc_feature: GYAE6OF01A4FCS.26.57.F02.1.454.CMB.1.raw
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggagcttggtccagccggggggtcctgaaactctcatgtgcaggctctggattcacattcagtgactcggctatatactgggtccnccagtctgccgggaaaggctggagtggcttggccgtattagaaccaaacctgacaagtacgcgacaattangctgcgtcggtncaaggcaggttcaccatctcagagatgattcagagaacacggcgtatctgcaatgaacagacctagaaaccgaggacacggcgtgtatactgtcgcagacactcgtacgtacttacgtattttcagtcgtaccg

SEQ ID NO: 59262 - DNA, 529 bp, Homo sapiens
  misc_feature: GYAE6OF01AQXE6.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaggctggagtggcttggccgtattagaaccaaacctgacaagtacgcgaacaatttangctgcgtcggtgcaaggcaggttcaccatctccagagatgattcagagaacacggcgtatctgacaaatgaacagacctagaaaccgaggaccgacggccgtagtattactgtgccagacactccgtacgtattacgtatttttcagttggtccg

SEQ ID NO: 59263 - DNA, 523 bp, Homo sapiens
  misc_feature: GYAE6OF01BLVXW.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtcctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgacaaatgaacagacctagaaaccgaggacacggccgtgtatactgtgcagacatccgtcgtacttacgtattttcagtggtacccg

SEQ ID NO: 59264 - DNA, 520 bp, Homo sapiens
  misc_feature: GYAE6OF01BMNC9.26.57.F02.1.454.CMB.1.raw
  modified_base (361)..(361): a, c, t, g, unknown or other
  misc_feature (361)..(361): n is a, c, g, or t
  modified_base (512)..(512): a, c, t, g, unknown or other
  misc_feature (512)..(512): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaactctcatgtgcaggctctggattcacattcagtgactcggctatatactgggtccgccagtctgccgggaagggctggagtggcttggccgtattagaccaacctgacaagtacgngacaatttatgctgcgtcggtgcaaggcaggttcaccatctccagagatgattcagagaacgacggcgtatctgacaaatgaacagacctagaaaccgaggacacggccgtgtattactgtgccagcactccgtcgtattacgtattttcngtgtcccg

SEQ ID NO: 59265 - DNA, 521 bp, Homo sapiens
  misc_feature: GYAE6OF01D8OSX.26.57.F02.1.454.CMB.1.raw
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggagcttggtccaggccggggggtcctgaaactctcatgtgcaggctctggattcacattcagtgactcggctatatactgggtccgccagtctgccgggaaggctggagtggcttggccgtattacggaaccaaacctgacaagtacgcgacaattangctgcgtggtgcaaggcaggttcacatctccagagatgattcagagaacacggcgtatctgacaaatagaacagacctagaaaccgaggacacggcgtgtatactgtgccagacactccgtcgtattacgtattttcagtcggtacccg

SEQ ID NO: 59266 - DNA, 528 bp, Homo sapiens
  misc_feature: GYAE6OF01C7PN1.26.57.F02.1.454.CMB.1.raw
  modified_base (376)..(376): a, c, t, g, unknown or other
  misc_feature (376)..(376): n is a, c, g, or t
  modified_base (517)..(517): a, c, t, g, unknown or other
  misc_feature (517)..(517): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaaggcaggttcaccatctccagagatgattcagagaacacggcgtatctgcaaatgaacagcctagaaaccgaggacacggccgtgtattactgtgccagacatccgtacgtattacgtattttttcngttggtacccg

SEQ ID NO: 59267 - DNA, 540 bp, Homo sapiens
  misc_feature: GYAE6OF01DDGY5.26.57.F02.1.454.CMB.1.raw
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaactctcatgtgcaggctctggattcacattcagtgactcggctatatactgggtccnccagtctggccgggaaagggctggagtggcttggccgtattacgaaccaaacctgaacaagtacgcgacaatttangctgcgtcggtgcaaggcaggttcaccatctcagagatgattcagagaacacggctatctgacaaatcgaacagacctaggaaaccggacgacgacggtcgtagtacttagtcgtcgaccagactacgtcctacgttattactttatttcgagttcgtaccg

SEQ ID NO: 59268 - DNA, 530 bp, Homo sapiens
  misc_feature: GYAE6OF01A30Z0.26.57.F02.1.454.CMB.1.raw
  modified_base (519)..(519): a, c, t, g, unknown or other
  misc_feature (519)..(519): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatagaacagacctagaaaccgacggacacggccgtagtattactgtcgcagacatccgtcgtacttacgtatttttcngttggtacccg

SEQ ID NO: 59269 - DNA, 586 bp, Homo sapiens
  misc_feature: GYAE6OF01CLV7J.26.57.F02.1.454.CMB.1.raw
  modified_base (384)..(384): a, c, t, g, unknown or other
  misc_feature (384)..(384): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctgaactctcatgtgcaggctctggattcacattcagtgactcggctatatactgggtccgccagtctggccgggaaagggctgggagtggcttggccgtattaacgaacctaaacctgaacaagtacgacgtaactaatttanacgtctcgcgttcggtgacgaaggcgaaggttccacctactcctaccgagacgatagtatacgtaagaacgaacgacggacgtatactagacgaaatacgaacacgaccgtacgaaaccggagacgaccggacgtagtacgttatcgtcgaccagacacgtaccgtacgttacttacgttatttttcgtagttcggtacccg

SEQ ID NO: 59270 - DNA, 545 bp, Homo sapiens
  misc_feature: GYAE6OF01B7EHZ.26.57.F02.1.454.CMB.1.raw
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccnccagtctggccgggaaagggctggagtggcttggccgtattagaaccaaacctgacaagtacgcgacaatttangctgcgtcggtgcaaggcaggttcaccatctcagagatgattacagaagaacacggcgtatctgacaaatagaacacgacctacgaaaaccgacggacgaccggccgtagtattactagtcgaccagacatccgtacgtacttacgttattttctagtcggtacccg

SEQ ID NO: 59271 - DNA, 587 bp, Homo sapiens
  misc_feature: GYAE6OF01EKSHG.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctgaaactctcatgtgcaggctctggattcacattcagtgactcggctatatactgggtccgccagtctgccgggaaagggctgggagtggcttggaccgtataagaaccaaactagacaagtacgacgactaattatgtctgcggtcggtgacgaagcaggttcaccactctccagagatagattacaagaagaacgacggacgtatctagacaaatagaacaacgaccgtaacgaaaccggaacggaaccgaccggaccgttacgtaacgttacgtcgtacgaccgacgacctaacgttaccgttacgttacgtttaaccgtttacttttttcgtacggttacgg

SEQ ID NO: 59272 - DNA, 542 bp, Homo sapiens
  misc_feature: GYAE6OF01AZ1G0.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccgccagtctgccgggaaagggctgggagtggcttggccgtattagaaccaaactgacaagtacgcgacaatttatgctgcgtcggtgcaaggcaggttcaccatctccagagatgattcagacgaacgacggcgtactctgacaaatagaacagacctaggaaaccgacggacacggcgtagtatacgtagtcgcacgacactccgtacgttacttacgttatttttctgtcggttacccg

SEQ ID NO: 59273 - DNA, 557 bp, Homo sapiens
  misc_feature: GYAE6OF01CUL0Q.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccgggggggtccctgaaactctcatgtgcaggctctggattcacattcagtgactcggctatatactgggtccgccagtctgccgggaaaggctggagtggcttggccgtattagaaccaaacctgacaagtacgcgacaatttangtctgacgtcggtgcgaaggcaggtcacgatctaccagagatagattcagagaacgacggacgtatctagacaaatagaacgagacctagaaaaccgaggacgacggtacgtagtattactgtacgaccagacacgttccgtacgttaacttaacgttatttttactaggttcggttacccg

SEQ ID NO: 59274 - DNA, 526 bp, Homo sapiens
  misc_feature: GYAE6OF01C2781.26.57.F02.1.454.CMB.1.raw
  modified_base (374)..(374): a, c, t, g, unknown or other
  misc_feature (374)..(374): n is a, c, g, or t
  modified_base (517)..(517): a, c, t, g, unknown or other
  misc_feature (517)..(517): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggagcttggtccaggccggggggtccctgaaactctcatgtgcaggctctggattcacattcagtgactcggctatatactgggtccgccagtctgccgggaaagggctggagtggcttggccgtattagaaccaaacctgacaagtacgcgacaatttangtctgcgtcggtgcaaggcagttcaccatctccagagatgattcagagaacacggcgtatctgacaaatgaacacgacctagaaaccgaggacacggccgtagtattactgtcgcagcacgtcgtacgtattacgtattttcngtgtacccg

SEQ ID NO: 59275 - DNA, 606 bp, Homo sapiens
  misc_feature: GYAE6OF01CQSP0.26.57.F02.1.454.CMB.1.raw
  modified_base (387)..(387): a, c, t, g, unknown or other
  misc_feature (387)..(387): n is a, c, g, or t
  modified_base (543)..(543): a, c, t, g, unknown or other
  misc_feature (543)..(543): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcttggtccgaggccgggggggtccctgaaactctcatgtgcaggctctggattcacattcagtgactcggctatatacgtgggtccgccagtctggacccgggaaagggccggagtggcttgggcctagtacgaaccaacgtgaacaagtacgcgaactaatttanggactggcgtcgggtagcgaaggcaggttaccacctatcctaccagagatgattacgagagaacgacggacgtatctagacaaatacgaacacgaaccgtaagaaaacccgagggaaccgaccggaccgttagttaacttacgtgtacgaccgtanaacctacgttacccgttacgttacgtttacgttaactttttacgaacgttcggtccctacggg

SEQ ID NO: 59276 - DNA, 533 bp, Homo sapiens
  misc_feature: GYAE6OF01BL2H8.26.57.F02.1.454.CMB.1.raw
  modified_base (524)..(524): a, c, t, g, unknown or other
  misc_feature (524)..(524): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggtcaccatctcagagatgattcagaagaacgacggcgtatctgacaaatagaacagacctacgaaaccgaggacgacggaccgtagtactactgtcgacagacactccgtcgtacttacgtattttcngttgtaccg

SEQ ID NO: 59277 - DNA, 603 bp, Homo sapiens
  misc_feature: GYAE6OF01DR7BN.26.57.F02.1.454.CMB.1.raw
  modified_base (395)..(395): a, c, t, g, unknown or other
  misc_feature (395)..(395): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtggaggtccgggggagcgttggtccgaggccggggggtccctagaaactctcatgtgcaggctctggattcacattcagtgactcggctatatacgtgggtccgccagttctggtacgggaaagggctggagtggcttgggccgtattaacgaaaccaaaccgtgaacaagtacgacgaactaatttangctgcggtcggtgacgaaggcaggttcaccatctaccaagagatgattcgaagagaacgacggtacgtatctagaacaaagtacgaaacacgtaacccgtaacgaaaaccggacggaaccgaaccggtaccgtagttaacttaacgtcgtcgaccaagcaacgttccgttacgttaacttacgttatttttacgagttcggtaacccg

SEQ ID NO: 59278 - DNA, 548 bp, Homo sapiens
  misc_feature: GYAE6OF01CG2IA.26.57.F02.1.454.CMB.1.raw
  modified_base (380)..(380): a, c, t, g, unknown or other
  misc_feature (380)..(380): n is a, c, g, or t
  modified_base (494)..(494): a, c, t, g, unknown or other
  misc_feature (494)..(494): n is a, c, g, or t
  modified_base (536)..(536): a, c, t, g, unknown or other
  misc_feature (536)..(536): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggaggcttggtccgaggccgggggggtccctgaaactctcatgtgcaggctctggattcacattcagtgactcggctatatactgggtccgccagtctggccgggaaggctggagtggcttggcgtattagaaccaaacctgacaagtacgacgaactaatttangctgcgtcggtgcgaaggcaggttcaccatctccagagatgattcagagaacgacggcgtatctagacaaatagaacgacgcctaagaaaccgaggacacggcgtagtattacngtcgacagacacgtccgtacgttacttacgttatttttacgngttcggtacccg

SEQ ID NO: 59279 - DNA, 521 bp, Homo sapiens
  misc_feature: GYAE6OF01EFXYV.26.57.F02.1.454.CMB.1.raw
  modified_base (302)..(302): a, c, t, g, unknown or other
  misc_feature (302)..(302): n is a, c, g, or t
  modified_base (513)..(513): a, c, t, g, unknown or other
  misc_feature (513)..(513): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttggtccaggccggggggtccctgaaactctcatgtgcaggctctggattcacattcagtgactcggctatatactgggtccnccagtctgccgggaagggctggagtggcttggccgtattagaaccaaacctgacaagtacgcgacaatttatgctgcgtcggtgcaaggcaggttcacgtatctccagagatgattcagagaacacggcgtatctgacaatagaacagactagaaaccgagacgacggccgtgtatactgtgcagacatccgtacgtattacgtattttcngtgtaccg

SEQ ID NO: 59280 - DNA, 521 bp, Homo sapiens
  misc_feature: GYAE6OF01E231J.26.57.F02.1.454.CMB.1.raw
  modified_base (513)..(513): a, c, t, g, unknown or other
  misc_feature (513)..(513): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaggctggagtggcttggccgtattagaaccaaacctgacaagtacgcgacaatttatgctgcgtcggtgcaaggcaggtcaccatctccagagatgattcagagaacacggcgtatctgcaaatagaacagacctagaaaccgaggacacggccgtgtattactgtgccagacatccgtcgtattacgtatttttcngtggtccc

SEQ ID NO: 59281 - DNA, 525 bp, Homo sapiens
  misc_feature: GYAE6OF01EVKON.26.57.F02.1.454.CMB.1.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggagcttggtcaggccggggggtcctgaactctcatgtgcaggctctggattcacattcagtgactcggctatatactgggtccncagtctggccgggaaggctggagtggcttggccgtattagaaccaactgacaagtacgcgacaatttangctgcgtcggtgcaaggcaggtcacatctccagagatgattcagacgaacgacggcgtatctgacaaatagaacacgacctagaaaccgaggacgacggcgtagtatactgtcgcagacactcgtacgttacttacttattttcgtgtcggtaccg

SEQ ID NO: 59282 - DNA, 573 bp, Homo sapiens
  misc_feature: GYAE6OF01EGWN3.26.57.F02.1.454.CMB.1.raw
  modified_base (299)..(299): a, c, t, g, unknown or other
  misc_feature (299)..(299): n is a, c, g, or t
  modified_base (441)..(441): a, c, t, g, unknown or other
  misc_feature (441)..(441): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtagctatttaaaagtgtcagtgtcaggtgcagctggtggagtccgggggaggcttggtccaggccggggggtccctgaaactctcatgtgcaggctctggattcactattcagtgactcggctatatactgggtccnccagtctggccgggaaagggctggagtggcttggccgtattagaaccaaacctgaccaagtacgcgaactaatttatgctgcgtcggtgctaaggcaggttccaccatctccagagatgatcagaagaacacggacgtatcngacaaatagaacacgaccgtaacgaaaaccggaggaacgaccgggaccgtagtaacgttacgtgtacgaccgaacggactaccgttccgttacgttaactttaacgttattttttacgagttcggtaccccg

SEQ ID NO: 59283 - DNA, 639 bp, Homo sapiens
  misc_feature: GYAE6OF01B5WCV.26.57.F02.1.454.CMB.1.raw
  modified_base (402)..(402): a, c, t, g, unknown or other
  misc_feature (402)..(402): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggaggtccgggggagcgttggtccgaggccggggggtccctggaaactctcatgtgcaggctcgtggattcacattcagtgactcggctatatacgtcgggtccgccagtcgtcggaccggggaaagggcgtggaggtgggcgttgggccgtaagttaacgaaaccaaaccgtgaactaagacgacgaactaaatttanagtctagcggtcggtagacgaaggcgacggttccaacctagtcctaccaaggaagtagtagtattacgaagaacggaaaccgacggtacgtaactcgtagaactaaagtacgaactacgtaccgtaaacggaaaccgacggaacgaccggccgttagttacttacgtcgtacgacccaggacctacgtaccggttacgttactttacgtttaacttttcgtacgttcggttacccgg

SEQ ID NO: 59284 - DNA, 565 bp, Homo sapiens
  misc_feature: GYAE6OF01ADQTL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaaagggctggagtggcttggccgtattacgaaccaactgaacaagtacgacgactaatttatgctgcgtcggtgcgaaggcaggttcaccatctccagagatgacttcagaagaacgacggcgtatcgtagacaagtacgaacgacgaccacggaaaacgacggaccgacggccgtgtacttacgtcgtcgacacgacacgttcccgtacgttaactttacgttactttttcgtggttcggttacccg

SEQ ID NO: 59285 - DNA, 532 bp, Homo sapiens
  misc_feature: GYAE6OF01D9VY1.26.57.F02.1.454.CMB.1.raw
  modified_base (304)..(304): a, c, t, g, unknown or other
  misc_feature (304)..(304): n is a, c, g, or t
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccaggcccgggggggtccctgaaactctcatgtgcaggctctggattcacattcagtgactcggctatatactgggtccnccagtctggccgggaaagggctggagtggctggccgtatagaaccaaacctgacaagtacgcgacaatttngctgcgtcggtgcaaggcaggttcaccatctcagagatgattcagagaacacggacgtatctgacaatagaacagacctagaaaccgaggacacggccgtagtacttactgtcgaccagacagtccgtacgtattacgtatttttcgtgtggtaccg

SEQ ID NO: 59286 - DNA, 553 bp, Homo sapiens
  misc_feature: GYAE6OF01BJDN0.26.57.F02.1.454.CMB.1.raw
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (540)..(540): a, c, t, g, unknown or other
  misc_feature (540)..(540): n is a, c, g, or t
tcagagactatactcacgaccggtgctcgatttagctcgatatagttgggtttggggcgtgggagaggagctccagccttgggattcccagctgtctccactcggtgatcggcactgaatacaagagactcaccatggagtttgggctgagctgggttttcctgttgctatttaaaaggtgtccagtgtcaggtgcagctggtggagtccgggggagcttggtccaggccggggggtccctgaaactctcatgtgcaggctctggattcacattcagtgactcggctatatactgggtccnccagtctgccgggaaaggctggagtggcttggccgtattagaaccaaacctgacaagtacgcgacaatttangctggcggtcggtgacgaaggctaggttcaccatctacagagatgattcgagagaacgacggcgtatctagacaaatagaacagacctacggaaaccgaggaccaccggccgtagttacgtattcgtcgaccagacactccgtacgttacttacgttatttttacgnggttcggtacccg

SEQ ID NO: 59287 - DNA, 561 bp, Homo sapiens
  misc_feature: GYAE6OF01D762B.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaggtgtcagtgtcaggtgcagctggtggagtccgggggagcttggtccaggccggggggtccctgaaactctcatgtgcaggctctggattcactattcagtgactcggctatatacgtgggtccgccagtcgtggccggggaaagggctgggagtggcttgggccgttattacgaacccaaacgtgaacaagtacgcgaactaatttancgctgcggtcggtgcaagggtcaggttcaccatctccagagatgattcaagagaacacggctatcagacaaatagaacacgtacctaagaaaccgaggacgacggccgtagtattacgtgtcgacagacacgttaccgtacgttaacttacgttatttttcgtaagttcgtacccg

SEQ ID NO: 59288 - DNA, 532 bp, Homo sapiens
  misc_feature: GYAE6OF01E4K4X.26.57.F02.1.454.CMB.1.raw
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccggggggaggcttggtccaggccgggggggtccctggaaactctcatgtgcaggctctggattcacattcagtgactcggctatatactgggtccgccagtctgccgggaaagggctggagtggcttggccgtattagaaccaactgacaagtacgcgacaatttangctgcgtcggtgcaaggcaggtcaccatctccagagatgattcagagaacacggcgtatctgacaaatagaacagacctacgaaaccgaggacgacggccgtgtatactgtgaccagacatccgtcgtacttacgtatttttctgtggtacccg

SEQ ID NO: 59289 - DNA, 590 bp, Homo sapiens
  misc_feature: GYAE6OF01BL4ZM.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggagtccgggggagcgttggtccgaggccggggggtccctgaaactctcatgtgcaggctcgtggattcacattcagtgactcggctatatacgtgggtccgccagtctggccgggaaagggctggagtggcgttggccgtatacgaaccaaacctgaacaagtacgacgactaatttangactgcgtcggtgacgaaggcaggtcacgtatcctacagagatgtatcaagagaacgacggacgtactctacgacaaatacgaacgacgtaccgtaacggaaaccggacggaccgacggtacgtaggtacttacgtcggtacgcaacgacctacgttcccgttacgttaacgtttacgtttagtttttccgaggttcggtacccg

SEQ ID NO: 59290 - DNA, 573 bp, Homo sapiens
  misc_feature: GYAE6OF01CWBHO.26.57.F02.1.454.CMB.1.raw
  modified_base (309)..(309): a, c, t, g, unknown or other
  misc_feature (309)..(309): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatcgtgcaggctctggattcactattcagtgactcggactatatacgtgggtccncagtctaggccgggaaaggctggagtggctggccgtagttacgaacaacctgacaagtacncgacaatttangtctgacgtcggtgcaaggctaggttacacatctccagagatagatcagtagacgacgcgtatctagacaagtagaacacgtaccgtaaggaaaccgacggacgaccggaccgttacgtacgttactacgtcgaccgacgactacgtccgttacgttacgtttacgttagtttttcgaggttcggttacccg

SEQ ID NO: 59291 - DNA, 529 bp, Homo sapiens
  misc_feature: GYAE6OF01EXUAR.26.57.F02.1.454.CMB.1.raw
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
  modified_base (445)..(445): a, c, t, g, unknown or other
  misc_feature (445)..(445): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactggggtccnccagtctgccggaaagggctggagtggcttggccgtattagaaccaaacctgacaagtacgcgacaatttangctgcgtcggtgcaaggcaggttcaccatctccagagatgatcagagaacacggcgtatctgacaatanaacggagacctagaaaccgaggacgacggccgtgtactactgtgaccagacatccgtcgttattactatttttctagtgtaccg

SEQ ID NO: 59292 - DNA, 589 bp, Homo sapiens
  misc_feature: GYAE6OF01ANC12.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtagctatttaaaagtgtcagtgtcagtgcagctggtggagtccgggggaggcttggtccaggccgggggggtccctgaaactctcatgtgcaggctctggattcacgatttcagtgactcggctatatactcgggtccgccagtctcggaccgggaaagggctgggagtcggtcttgggccgtagttagaaaccaaccgtgaacaagtacgcgtaactaatttatgctgcgtcggtgcgaaggcaggttcacatctccagagatgatacgagtacgacgacggacgtagtcgtagacgtaatacgaacagacccgtagaaaccgtacggaccgaccggtccgtacgtacttacgtacgtcgacgacgtactacgttaccgttaccgttaacgtttacgttaagtttttcgtacggttcggtaacccg

SEQ ID NO: 59293 - DNA, 853 bp, Homo sapiens
  misc_feature: GYAE6OF01CXD4Q.26.57.F02.1.454.CMB.1.raw
  modified_base (402)..(402): a, c, t, g, unknown or other
  misc_feature (402)..(402): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctggtgggaggtccgggggaggcgttggtccgagggcccgggggggtccctagaaacctctcatgtgcaggctcgtggattcacattcagtgactcggctatatacgtgggtccgcagtctggaccggggaaaggcgtggagtggcgttggccgtattaacgaacctaaaccgtgaacaagtacgacgtaactaatttagngcgtggtcggtcgggtgaccgaagggtcgtacgggttaccaacccgtacttacccgttacccgaaggtaacgtaacgttacggttaaactttaccgaacggtaaacgggtaaacccggaaccggggtaacccggtttaaacgttacccgttaacgggtaaccgtaaaaacgtttaacggaaaacccggtaaccgggtaacccccgttaaaacgggaaaaaaccccgggttaaccgggggaaccccgtaaacccgggggttaacccgggtttaaccgggttaaaccgttttaacccgttacgggttacccggtaaaccccggaaacggtaaaccccgttaaacccggtttaaccccgggtttaccggtttttaaaccggttttaaacccggttttaaccgtttttttttaacccggtaacggggttttaccccgggttttaaaccccccggg

SEQ ID NO: 59294 - DNA, 554 bp, Homo sapiens
  misc_feature: GYAE6OF01CIXUQ.26.57.F02.1.454.CMB.1.raw
  modified_base (383)..(383): a, c, t, g, unknown or other
  misc_feature (383)..(383): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcttggtccgaggccgggggggtccctgaaacctctcatgtgcaggctctggattcacattcagtgactcggctatatactgggtccgccagtctggccgggaaagggctggagtggcttggccgtattagaaccaaacctgacaagtacgcgacaatttangctgcgtcggtgcgaaggcaggttcaccatctccagagatgattcagagaacacggcgtatctagacaaatacgaacacgcctacgaaaccgaggacacggccgtgtacttctagtcgaccagactacgtcccgttacgttacttacgttatttttctggttcggtacccg

SEQ ID NO: 59295 - DNA, 578 bp, Homo sapiens
  misc_feature: GYAE6OF01EEH7D.26.57.F02.1.454.CMB.1.raw
  modified_base (567)..(567): a, c, t, g, unknown or other
  misc_feature (567)..(567): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttaattttaaaaggtgtccagtgtcaggtgcagctggtggaggtccgggggaggcttggtccgaggcccggggggtccctgaaactctcatgtgcaggctcgtggattcgactattcagtgactcggctatatacgtgggtccgccagtctcggccgggaaaggctggagtggcttggcctattagaaccaaaccgtgaacaagtacgacgactaattatgctgcgtcggtgacgaaggcacggtcacctactctacagagatagattacgagaagaacgacggacgtatctagacaaagtacgaacacgacctaacgaaaccgagaaccgacgtacgtagttacttacgtcgtcgaccgagaccgtacgtccgtacgttacgttacttactttttcgngttcgtacccg

SEQ ID NO: 59296 - DNA, 532 bp, Homo sapiens
  misc_feature: GYAE6OF01EH68W.26.57.F02.1.454.CMB.1.raw
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaggtgtcagtgtcaggtgcagctggtggagtccgggggagcttggtccaggccggggggtccctgaaactctcatgtgcaggctcgtggattcacattcagtgactcggctatatactgggtccgcagtctggccgggaaagggctggagtggcttggccgtattagaaccaaactgacaagtacgcacaatttangctgcgtcggncaaggcaggttcaccatctccagacgatgattacagagaacgacggcgtatctgacaatagaacagacctagaaacgaggacacggcgtgtatacgtgtgacgagacacgttccgtacgttacgttacgtatttttcaggttcgtacccg

SEQ ID NO: 59297 - DNA, 653 bp, Homo sapiens
  misc_feature: GYAE6OF01ECWWD.26.57.F02.1.454.CMB.1.raw
  modified_base (187)..(187): a, c, t, g, unknown or other
  misc_feature (187)..(187): n is a, c, g, or t
  modified_base (257)..(257): a, c, t, g, unknown or other
  misc_feature (257)..(257): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtaggcgtattaaagtagtcagtgtnagtgcagctggtgagccggggaggctggtccgaggccggggggtccctggaaactctcatgtgcaggctntggattcacattcagtgactcggctataatcttgggtccaccgtagtcgtcggccgggaaaggctgggagtggccgttggccgttaattagaaccgaaacctgaacctaagtacgacgtanaattttagngtcgtgcgtggcgacgaggtacgtacgttccactactacgtacgagagtatacgtaatacgaacgaacgaacgacggtacgtactacgtacgaactaaacgtaacgaaacgaaccgtaaccgaaacggaaaccgtaacgggaaccggtaccggtacggttacgttaacgttaccgtacggtaccgtacgtaacgtaaccgtaccgttaccggttaacgtttaccgttttaacggtttacgtttttaccggtacggttccggtaccg

SEQ ID NO: 59298 - DNA, 594 bp, Homo sapiens
  misc_feature: GYAE6OF01CZWC5.26.57.F02.1.454.CMB.1.raw
  modified_base (154)..(154): a, c, t, g, unknown or other
  misc_feature (154)..(154): n is a, c, g, or t
  modified_base (168)..(168): a, c, t, g, unknown or other
  misc_feature (168)..(168): n is a, c, g, or t
  modified_base (176)..(178): a, c, t, g, unknown or other
  misc_feature (176)..(178): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (215)..(216): a, c, t, g, unknown or other
  misc_feature (215)..(216): n is a, c, g, or t
  modified_base (219)..(219): a, c, t, g, unknown or other
  misc_feature (219)..(219): n is a, c, g, or t
  modified_base (222)..(223): a, c, t, g, unknown or other
  misc_feature (222)..(223): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggngttcgtctaggcgntaagtgcnnnagncngnngngncggngctgcngcgggcngacncnanngcngcnngatncatcatgctgcatatctggcgcngcngccggaaggcgtggngtgtcgtcgtcgtatacgaacaactacgacgaacgtacgacgtactaattatcgtcgtcgtcggtcggtacgtacgtacgtacgtacgtaccgtacgtactacgtacgacgacgtagtacgtacgtacgtaacgtaacgtaaccgtaacggtacgtacgtacgtacgtaacgtaaacgtaacgtaacgaaccgtaaccgtaaaccggtaaaccggtaaccggaccgtaccggtaccggtacgtacgttacgtacgtacgtacgaacgtaccgtaccgttaccgttacgttaacgttacgtttacgtttacgttacggtacgtaccg

SEQ ID NO: 59299 - DNA, 543 bp, Homo sapiens
  misc_feature: GYAE6OF01DRVK0.26.57.F02.1.454.CMB.1.raw
  modified_base (378)..(378): a, c, t, g, unknown or other
  misc_feature (378)..(378): n is a, c, g, or t
  modified_base (531)..(531): a, c, t, g, unknown or other
  misc_feature (531)..(531): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccggggggaggcttggtccaggccgggggggtccctgaaactctcatgtgcaggctctggattcacattcagtgactcggctatatactgggtccgccagtctggccgggaaaggctggagtggcttggccgtattacgaaccaacctgacaagtacgcgactaatttangctgcgtcggtgcgaaggcaggttcaccatctccagagatgattcagagaacgacggacgtatctgacaaatgaacagcctagaaaccgaggacgacggccgtagtacttactgtcgacagacacgtccgtacgttacttacgttatttttcngttcggtacccg

SEQ ID NO: 59300 - DNA, 598 bp, Homo sapiens
  misc_feature: GYAE6OF01EA0UW.26.57.F02.1.454.CMB.1.raw
  modified_base (218)..(218): a, c, t, g, unknown or other
  misc_feature (218)..(218): n is a, c, g, or t
  modified_base (367)..(367): a, c, t, g, unknown or other
  misc_feature (367)..(367): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtgtttcgtgtagctattaaagtgtcagtgtcaggtgcagctggtggagtccggggagcttggtccnggccggggggtcctgaaactctcatgtgcaggctctggattcactattcagtgactcgctatgtacgtggtccgccagtcgtggccgggaaggccgagtggcttggccgtattacgaaccaacctgacaagtacgcgaactaatttagngctcgcgtcggtgacgaggtctacgtacactactacgtacgagagtagtacgtactacaagtaacgaacgacgtacgtactacgtacgaacgtaagtacgaacgacgtaccgtaaacggaaaccggacggaaccgtacggtaccgtagttaacgttacgtacgtacgaccgtagactacgttaccgttacgttacgtttacgtttacgtttacgacggttccgtcgtacgg

SEQ ID NO: 59301 - DNA, 829 bp, Homo sapiens
  misc_feature: GYAE6OF01DNTB2.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggagcgttggtccgagggcccgggggggtccctgaaaccgtctcgatgtgcgaggtcctcgtggattcacatttcagtgactcggctatatacgtcgggtccgccagtccgtggaccggggaaggcgtagggagtggtcgttgggacccgtagttaaccgaaacctaaaccgtgaaacgtaaacggtaaccgacgtaactaaatttacgtagcgttaggccggttacgggttcgaaccggaaacgggtccgtaacgggtttccctaacccgtaaccgttaccttacccggaaggtaacggtaagttacggtaacgtttaaccgaaacgggtaaacgtaaaccggtaaccgggttaaccgttaacgttacgtacgtaaacgtaaaacgtaacggaaaaccgtaccggtaacccgttaaaacgggaaaaacccgggtaacgggaacccgtaacccggggttaccggttaacggtttaaccgtttaaccggttaaccggtccggtaaccccggtaaacggtaaccgttaacccgtttaccccgggttaaccggttttaaacgttttaacccggttttaatttttttcccggtaaacggtttcccgggttaaccccgg

SEQ ID NO: 59302 - DNA, 552 bp, Homo sapiens
  misc_feature: GYAE6OF01BJT4B.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctctggattcacattcagtgactcggctatatactgggtccgccagtctggccggggaaagggccggagtggcttggccgtattagaacccaaacctgacaagtacgcgacaatttatgctgcgtcggtgcaaggcagtcaccatctccagagatgattcagagaacacggacgtatctagacaatgaacagaccgtagaaaccgaggaccgacggccgtgtattacgtgtcgcagacacgtcccgtcgttacttacgttacgtttttcggtcggttcccgtagtcggg

SEQ ID NO: 59303 - DNA, 539 bp, Homo sapiens
  misc_feature: GYAE6OF01DM7JT.26.57.F02.1.454.CMB.1.raw
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggagctggtccaggccggggggtcctgaactctcatgtgcaggctctggattcacattcagtgactcggctatatactgggtccnccagtctggccgggaaggctggagtggcttggcctattagaaccaaacctgaacaagtacgcgacaaatttangctgcgtcggtgacaaggtcaggttcaccactcactagagatgattacagagaacgacggacgtatactagacaaatagaacagacctagaaaccgaggacacggcgtagtatacgtgtcgacacgacacgtccgtacgttacgttacgttatttttctgtgtacccg

SEQ ID NO: 59304 - DNA, 615 bp, Homo sapiens
  misc_feature: GYAE6OF01DNRNU.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttctgttgctatttaaaggtgtcagtgtcaggtgcagctggtggagtccgggggagcttggtccagccggggggtccctgaactctcatgtgcaggctctggattcacattcagtgactcggctatatacgtgggtccgccagtctggcccggggaaaggctgggagtggcttgggccgtaattagaaccaaaccgtgacaggtaacgcgtactaatttcgtagctgcgtcggtagccgaagggcgtaggttccaacccgtatccgtaccaggagaacgtagtagttacgagaacggtaacgacggtacgtacgtcgtagactaaagtagaaaccacggaccctaacggaaaaccggacggaccgtacgggtacccgttagtattacgtaggtcgaccgacggtaccacgtaccgttaccgttaagtttacgtttattttttacgaggttcggtacccg

SEQ ID NO: 59305 - DNA, 530 bp, Homo sapiens
  misc_feature: GYAE6OF01CALMM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtccgcagtctgccgggaaagggctggagtggctggccgtattagaaccaaacctgacaagtacgcgacaatttatgctgcgtcggtgcaaggcaggttcaccatctccagagatgattcagagaacacggcgtatctagacaaatagaacagcctagaaacgaggacacggcgtgtatacgtgtcgacagacactccgtacgttacttacgtatttttcagttcggtacccg

SEQ ID NO: 59306 - DNA, 561 bp, Homo sapiens
  misc_feature: GYAE6OF01EMX1M.26.57.F02.1.454.CMB.1.raw
  modified_base (377)..(377): a, c, t, g, unknown or other
  misc_feature (377)..(377): n is a, c, g, or t
  modified_base (549)..(549): a, c, t, g, unknown or other
  misc_feature (549)..(549): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggagcttggtccaggccggggggtccctgaaactctcatgtgcaggctctggattcactattcagtgactcggctatatacgtgggtccgccagtcgtggccgggaaaggctgggagtggcttggcgtattagaaccaactgacaagacgcgacaatttangctgcgtcggtgcgaaggctacggtcaccatctacagagatgtattcagaacgaacgacggacgtatctagacaaagtacgaacgacgaccgtaacgaaacgacggacgacggccgtagtacgttactggtcgacacgacacgttccgtacgttacttacgttatttttcgngttcggtacccg

SEQ ID NO: 59307 - DNA, 543 bp, Homo sapiens
  misc_feature: GYAE6OF01EJH8L.26.57.F02.1.454.CMB.1.raw
  modified_base (444)..(444): a, c, t, g, unknown or other
  misc_feature (444)..(444): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctatttaaaggtgtccagtgtcaggtgcagctggtggaggtccgggggaggcttggtccgaggccgggggggtccctgaaactctcatgtgcaggctctggattcactattcagtgactcggctatatacgtgggtccgcagtcgtggccgggaaaggctgggagtggcgttggccgtatacgaaccaaactgacaagtacgacgactaatttatgctgcgtcggtgcgaaggcgagtcaccatcctcagagatgattcagagaacgacggcgtatcngacaatagaacagacctagaaaccgaggacgacggtacgtagtacttacgtgtcgacagacacgtccgtacgttacttacgttattttctgtcgtaccg

SEQ ID NO: 59308 - DNA, 521 bp, Homo sapiens
  misc_feature: GYAE6OF01E2OM1.26.57.F02.1.454.CMB.1.raw
  modified_base (371)..(371): a, c, t, g, unknown or other
  misc_feature (371)..(371): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaactctcatgtgcaggctctggattcacattcagtgactcggctatatactgggtccgccagtctgccgggaaagggctggatggcttggccgtattagaaccaactgacaagtacgcgacaatttngctgcgtcggtgcaaggcaggtcaccatctccagagatgattcagaagaacacggcgtatctgacaaatagaacagacctagaaaccgagacgacggcgtgtatactgtcgcagacatccgtcgtacttacgtattttcagtcgtacccg

SEQ ID NO: 59309 - DNA, 575 bp, Homo sapiens
  misc_feature: GYAE6OF01DPMHK.26.57.F02.1.454.CMB.1.raw
  modified_base (304)..(304): a, c, t, g, unknown or other
  misc_feature (304)..(304): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttggtccaggccgggggggtccctgaaactctcatgtgcaggctctggattcacattcagtgactcggctatatactgggtccncagtctggcgggaagctggagtggcttggccgtatagaaccaactgaacaagtacgcgaactaatttatgactggcgttcggtgcaagggctaggttcaccactctaccgagagaatgattcgagagaacgacggcgtatctagacaaatagaacacgtaccgtaacggaaaaccgaggaaccgacgggaccgttagtacttacgtcggtacgacccagaccacgttccgttacgttacgtttacgttatttttacgtgttcggttacccg

SEQ ID NO: 59310 - DNA, 562 bp, Homo sapiens
  misc_feature: GYAE6OF01ECKOU.26.57.F02.1.454.CMB.1.raw
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttggtccaggccgggggggtccctgaaactctcatgtgcaggctctggattcacattcagtgactcggctatatactgggtccnccagtctgccgggaaaggctgggagtggcttggccgtattagaaccaaactgacaagtacgcgacaatttangctgcgtggtncaaggcaggttcaccatctccagagatgattcagtaagaacgacggacgtatctagacaaatacgaacacgaccgtaacgaaaccggaggaccgacggaccgtagtacttacgtgtcgaccagactacgtccgtacgttaactttacgttattttttacaggttcggttacccg

SEQ ID NO: 59311 - DNA, 541 bp, Homo sapiens
  misc_feature: GYAE6OF01BUKUO.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccagccggggggtcctgaaactctcatgtgcaggctctggattcacattcagtgactcggctatatacgtgggtccgccagtctggccgggaaagggctggagtggcttggccgtattagaaccaaacctgaacaagtacgcgactaatttangctgcgtggtgcaaggcaggtcaccatctccagagatgattcagagaacacggcgtatctagacaaatcgaacagacctaaggaaaccgaggacacggaccgtagtacttacgtgtgaccagacacgtccgtacgttacttacttatttttcaggtcgtacccg

SEQ ID NO: 59312 - DNA, 546 bp, Homo sapiens
  misc_feature: GYAE6OF01DLDR3.26.57.F02.1.454.CMB.1.raw
  modified_base (383)..(383): a, c, t, g, unknown or other
  misc_feature (383)..(383): n is a, c, g, or t
  modified_base (537)..(537): a, c, t, g, unknown or other
  misc_feature (537)..(537): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccaggccggggggtccctgaactctcatgtgcaggctctggattcacattcagtgactcggctatatacgtgggtccgccagtcgtggaccgggaagggcgtgggagtggcgttggccgtattacgaaccaaacctgacaagtacgcgaactaatttangctggcgtggtgcgaacggcaggttcacactctaccagagatgtatacgagacgaacgacggctatctagacaaatgaaacagaccagaaacgaggacgacggcgtagtatacgtgtcgacagacactccgttactacgttacgttattttacngtggtaccg

SEQ ID NO: 59313 - DNA, 762 bp, Homo sapiens
  misc_feature: GYAE6OF01CLWFC.26.57.F02.1.454.CMB.1.raw
tcagagactatactcacgaccggtgctcgatttagctcgatatagttgggtttggggctgggagaggagctccagccttgggattcccagctgtctccactcggtgatcgacactgaatacaagagactcaccatggagtttgggctgagcttgggttttccttgttgcttattttaaaaggtgtccagtgtcaggtgcagcgtgggtgggaggtccggggggaggtcgttgggtccgacgggcccgggggggtccctaggaaacctctcagtggtgcgaggctcgtggattcactattcagtgacgtcggactatactacgtcgggtccgccgagtccgtagggacccgggaaagggccgtagggacggtcggtcgttgggacccgttaattaacggaaacctaaaccgtgaaaccaaaggttaccggacgtaaacttaaattttagtacgtcgtaggtccggttacgggtagaccgaagggccgtacgggtttacccaacctacgtcctaccgaacgtaagtacgtacgtacgtttacgaacggtaaacggaaaccgtaacggtacgtaactcgtacgaacgtaaacgtacgaaaccgaacggtacccgtaaacggaaaacccgggaacgggaacccgtaaccgggtaccggttacggttaaacgtttacggtacggttacgacccgtaacggtaccgtacgttacccggttacgtttaacgtttaacgtttacgtttttacgtacggttcggtaacccg

SEQ ID NO: 59314 - DNA, 625 bp, Homo sapiens
  misc_feature: GYAE6OF01DRG89.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctggtggaggtccgggggagcttggtccgaggccggggggtccctgaaactctcatgtgcgaggcttcgtggactttcactattcgaaggttgactcggctatataccgttgggtcccgccagtccgtggaccgggtaaaggcgtggagttggcgttggaccgttataacgaaccaaacgtgaacaagtacgacgaactaatttagtgcgtgcgtggtcgactaacgggctacggttacaacctactctaccagaacgtatagtattacgagaacgaacgacggtactagtacgagtaacaaagtacgaacgacgtacgaaggaaaccgaacggaccaaccggccgttagtacctacgtaggtcgtacacgtaccacgttaccgtacgttaaacgttacttagtttttactaggtccgtaccgg

SEQ ID NO: 59315 - DNA, 599 bp, Homo sapiens
  misc_feature: GYAE6OF01CR1LI.26.57.F02.1.454.CMB.1.raw
  modified_base (300)..(300): a, c, t, g, unknown or other
  misc_feature (300)..(300): n is a, c, g, or t
  modified_base (400)..(400): a, c, t, g, unknown or other
  misc_feature (400)..(400): n is a, c, g, or t
  modified_base (586)..(586): a, c, t, g, unknown or other
  misc_feature (586)..(586): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtgggaggtccggggggaggcgttggtccgagggcccgggggggtccctaggaaactctcatgtgcaggctctggattcacattcagtgactcggntatatacgtgggtccgcagtctcggccgggaaagggcgtggagtggtcgttggccgtattacgaacctaaacctgaacaagtacgacgaacaaatttagngctggcgtcggtgacgaaggcaggttcacctactctacagagatagacttacagaagaacgacggtacgtatctagacaaatacgaacgacgtacctaacggaaaccggaggaaccgaccggccgttagtacttacgtcgtacgaccagactacgtccgttacgttactttacgttatttttacgngttcggttacccg

SEQ ID NO: 59316 - DNA, 628 bp, Homo sapiens
  misc_feature: GYAE6OF01B9U7P.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccgggggggtccctgaaactctcatgtgcaggctctggattcactattcagtgactcggactatatacgtgggtccgccagtcgtcggaccgggaagggcgtggagtggcgttggccgtatacgaaccaacctgaacaagtacgcgactaatttangtctgcgtcggtgacgaaggcgtaggttaccacctattccgtaccgagaagtagtagtattacgaagaacgaaccgacggtacgttactcgtagaacgaaagtacgaacgaacgtaccgtaacgaaaaccggacggaccgaccggtaccgtacgtacgttacgtacggtcgtacccgaacgacctacgtaccggttacgttaacgtttaacgtttactttttacgtacggttcggttaacccg

SEQ ID NO: 59317 - DNA, 884 bp, Homo sapiens
  misc_feature: GYAE6OF01DL8MJ.26.57.F02.1.454.CMB.1.raw
  modified_base (668)..(668): a, c, t, g, unknown or other
  misc_feature (668)..(668): n is a, c, g, or t
tcagagactatactcacgaccggtgctcgatttagctcgatatagttgggtttggggctgggaggaggagctccagccgttgggacttcccagctgtcctccacgtcggtgagtcggcactgaataacaagagactcaccagtggtagtttggctgagtcgtttgggtttttccttgttgtactttaaagttttaaaaggtgtccagttgtacgaggtcgcagcgtgggtgggacgggtccggggggaggtcgttcggtccggacggggtcccggggggtccctaggtaaccttctacgagtgtcgcgaggtctcgtggtacttaccacgtattcgagtgacgtcggacttagttactacggtcgggtcccgaccgtagttccgtacgggaacccggggtaaaaggtccgtagggtacggtcgggttccgttacgggtacccgtttaaagttaaacccgaaaacccgtaaaccgttacggaaaccgtaaaacgggttaccgaaccgtaaactttaaagtttacgcggtacgtcggtaccgggttaggtacgaaccggtaacgggtccgtaacggtttacccaaccgtacgttccccgtaaccgtaaggtaacgtaacgtacgttaacttacgaacggaaacgtaaacccggtaacggtacgtttaacncgtaacgtaacgtaacgtaacgtaaacgaaccggtaacccggtaaaacggaaaaaccccggtaaggggtaacccggtaaccgggtacccggtttaacggttaaccgttacgtacggttaaccgaaccgtaacgtaccgttaacccggtttcccggttaaacgtttacgttttaaccgttttacgttttttaccggtaggtttcccggttaacccgg

SEQ ID NO: 59318 - DNA, 572 bp, Homo sapiens
  misc_feature: GYAE6OF01CCE6P.26.57.F02.1.454.CMB.1.raw
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccgaggccggggggtccctgaaactctcatgtgcaggctcgtggattcacattcagtgactcggctatatacgtgggtccncagtctggccgggaaagggcgtggagtggcgttggccgtattacgaaccaaactgaacaagtacgcgactaatttngctgcggtggtgacgaaggcacggtcaccactctacgagagatagattacgtaagaacgaacgacggacgtacgtctagacaaagtacgaacacgtaccgtaagaaaccgaggacgacggtaccgtagtactacgtgtcgacaggcacgttaccgtacgttacttacgttatttttctaggttcgtacccg

SEQ ID NO: 59319 - DNA, 798 bp, Homo sapiens
  misc_feature: GYAE6OF01DFNOH.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctattttaaaaggtgtccagtgtcaggtgcagctggtggaggtccgggggagcgttggtccgaggccgggggggtccctagaaacctctcatgtgcgaggctcgtggatttcgacattcagttgactcggctatatacgtgggtcccgccagtctggaccgggaaagggcgtaggagtcggcgtttcgggaccgttagttaacgaaacccgtaaaccgtgaaaccgaaacggttaaccgaccggtaaacctaaagttttacgtggtacgttcggaccgggttccggtacggaaccggaaacgggtaccgtaacgggtttaccctaaacccgtacttacccgtacccgaaggtaacgtaagtaaggtacgtttacgaaggtaaacgaaaccgtaaccggtaccggttaacgtccgtaacgtaacgtaaagtaacgtaaaccgaacgtaacccgtaaacgggaaaacccggaacgggtaacccgaaccgggtacccgttacggttaacgtttaaccgttacggttaccggaacccgtaacggtaaccgtaaccggttacccggtttaaccggtttaaacgttttaaccggtttaagtttttttacccgtacggtttccggtttaacccccgg

SEQ ID NO: 59320 - DNA, 562 bp, Homo sapiens
  misc_feature: GYAE6OF01B1CY1.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatacgtgggtccgccagtctggccgggaaagggctggagtggcttggccgtattacgaaccaaacctgaacaagtacgcgaataatttatgctgcgtcggtgcaaggcaggtcaccatctccagagatgtatcgagagaacgacggacgtatctagacaaatacgaacacgtacctaagaaaccggaggaccacggccgtagtacttacgtgtcgaccagaccacgttccgtacgttactttacgttatttttactggttcggttacccg

SEQ ID NO: 59321 - DNA, 552 bp, Homo sapiens
  misc_feature: GYAE6OF01EKRV0.26.57.F02.1.454.CMB.1.raw
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctgggtggaggtccgggggaggcttggtccaggccggggggtccctgaaactctcatgtgcaggctctggattcacattcagtgactcggctatatactgggtccncagtctgccgggaaggctgggagtggctggccgtattacgaaccaacctgacaagtacgcgaacaatttangctgcgtcggtgcaaggcaggttcaccatctccagagatgattacgaagagaaccgacggcgtatctagacaaagtgaacagtaccgtaagaaaccgaggaccgacggccgtagtacttacgtggtcgacacgactacgtaccgtacgttacttacgttattttctagtcggtacccg

SEQ ID NO: 59322 - DNA, 600 bp, Homo sapiens
  misc_feature: GYAE6OF01AJXLM.26.57.F02.1.454.CMB.1.raw
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaactctcatgtgcaggctctggattcacattcagtgactcggctatatactggggtccgccagtctggcccgggaagggctggagtgggcttggccgtatttagaacccaaacctgaacaacgtacgcgaacaatttangctgcgtcggngcaaggctacggttcacctatcctccgagagatgattcgagaacgaacgacggcgtactctacgacaaagtacgaacgacgacccgtaacggaaaccggaacggaccgaaccgggccgtagttacttacgtcggtacgccacggacctaacgttcccggttacgttaacgtttaacgtttattttttacgcggtttcggttacccg

SEQ ID NO: 59323 - DNA, 555 bp, Homo sapiens
  misc_feature: GYAE6OF01BNYEW.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaagggctggagtggcttggccgtattagaaccaactgacaagtacgacgacaatttangctgcgtcggtgcgaaggcaggttcaccactctcagagatgattcagacgaacacggacgtatctagacaaatacgaacacgaccgtaacgaaaaccggaggaccgaccggtccgtagttacttacgtgtcgacagacacgtccgtacgttacttacgttatttttcagttcggtacccg

SEQ ID NO: 59324 - DNA, 685 bp, Homo sapiens
  misc_feature: GYAE6OF01CBMGM.26.57.F02.1.454.CMB.1.raw
  modified_base (399)..(399): a, c, t, g, unknown or other
  misc_feature (399)..(399): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccgggggagcttggtccgaggccggggggtccctagaaactctcgatgtgcaggctcgtggattcactattcagtgactcggctatactacgtcgggtccgcagtctggaccgggaaagggctgggagtcggtcgttggccgtaattaacgaaacaaaccgtgaactaagtacgacgactaatttagngctagtcgtcggtgacgaaggcgtaggtccacctactactaccaagacgatagattcgaagaacgaacgacggcgtactacgtacgaactaaacgtacgaaaccgaacgtaccgtaaacggaaaaacccgggtaacggaccggtaaccgggtaccggttaacggttaagtttaaccgtcggtaccggtaacccgtaaacggtaccgttaaccgttacccggttaaacgtttacgttttaaacccgttttaagttttttaccgtaacgggttcccggtttaacccgg

SEQ ID NO: 59325 - DNA, 552 bp, Homo sapiens
  misc_feature: GYAE6OF01AWPVW.26.57.F02.1.454.CMB.1.raw
  modified_base (367)..(367): a, c, t, g, unknown or other
  misc_feature (367)..(367): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtcctgaactctcatgtgcaggctctggattcacattcagtgactcggctatatactgggtccgccagtctgccgggaaggctggagtggcttggcgtatagaaccaactgacaagtacgcgacaatttangctgcgtcggtgcaaggcaggttcaccatctccagagatgattcagagaacacggcgtatctagacaaagtacgaacacgtacctaacggaaaccgacggaaccgaccgggtaccgtagttacttacgtgtcgaccgagactacgtccgttacgttattacgttagttttctaggttcggtaccg

SEQ ID NO: 59326 - DNA, 543 bp, Homo sapiens
  misc_feature: GYAE6OF01AFIEV.26.57.F02.1.454.CMB.1.raw
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccgaggccgggggggtccctgaaactctcatgtgcaggctctggattcacattcgagtgactcggctatatactgggtccgccagtctgccgggaaagggctgggagtggcttggccgtattaacgaaccaaacctgacaagtacgcgactaatttatgctgcgtcggtgacaggcaggttcaccatctcagagatgtatnagtagaacacggcgtatctnacaaatagaacacgacctacgaaaccgaggacgacggcgtagtacgttactgtcgacaagcatccgtacgtaattacgtatttttcagttcgtacccg

SEQ ID NO: 59327 - DNA, 526 bp, Homo sapiens
  misc_feature: GYAE6OF01A3F6U.26.57.F02.1.454.CMB.1.raw
  modified_base (516)..(516): a, c, t, g, unknown or other
  misc_feature (516)..(516): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctggccggaaagggctggagtggcttggccgtattagaacccaaacctgacaagtacgcgacaattatgctgcgtggtgcaaggcaggttcaccatctccagagatagattcagagaacacggcgtatctgacaaatagaacagactagaaaccgaggacacggccgtagtagttactgtcgacagacactcgtctattacgtattttcngttggtaccg

SEQ ID NO: 59328 - DNA, 572 bp, Homo sapiens
  misc_feature: GYAE6OF01DPSUV.26.57.F02.1.454.CMB.1.raw
  modified_base (308)..(308): a, c, t, g, unknown or other
  misc_feature (308)..(308): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcttggtccgaggcccgggggggtccctgaaactctcatgtgcaggctctggattcacattcagtgactcggctatatactgggtccnccagtctggccgggaaagggctgggagtggcttggccgtattagaacccaaacctgaacaagtacgcgactaattatgctgcgtcggtgcaaggcaggttcacctatctaccagacgatgtatacagaacgaacgacggcgtatcgtagacaaatgaacagaccgtaacgaaaaccgacggacgaccggaccgtagtacgttacgtggtcgacgacgacacgtaccgtacgttactttacgttatttttcgtgttcggtacccg

SEQ ID NO: 59329 - DNA, 617 bp, Homo sapiens
  misc_feature: GYAE6OF01DTMA2.26.57.F02.1.454.CMB.1.raw
  modified_base (408)..(408): a, c, t, g, unknown or other
  misc_feature (408)..(408): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctattttaaaaggtgtccagtgtcaggtgcagcgtggtgggaggtccgggggaggcgttggtccgaggcccgggggggtccctgaaacctctcagtgtgcaggctcgtggattcacattcagtgactcggctatatacgtgggtccgccagtcgtggaccgggaaagggctgggagtggcgttggaccgtaagttaacgaaacccaaaccgtgaaccgaaagtacgcgtaactaatttangtctgcggtcggtgcgaaggctaggttccaccatcctaccagagtatgattacgaagaacgaacgacggacgtagtctagacgaaatacgaacacgtaccgtaacgaaaccggaggaccgacggaccgtagttacttacgtacgtcgaccagaccgtacgttcccgtacgttaacgtttacgtttatttttacgtgttccggttacccg

SEQ ID NO: 59330 - DNA, 530 bp, Homo sapiens
  misc_feature: GYAE6OF01BJJJG.26.57.F02.1.454.CMB.1.raw
tcagagactatactcacgaccggtgctcgatttagctcgatataggttgggtttggggctgggagaggagctccagccttgggattcccagctgtctccactcggtgatcggcactgaatacaagagactcaccatggagtttgggctgagcgtggtttctgtgctatttaaagtgtcagtgtcaggtgcagctggtggagtccgggggaggcttggtccaggccggggggtccctgaaactctcatgtgcaggctctggattcacattcagtgactcggctatatactgggtccgccagtctgccgggaaagggctggagtggcttggccgtattagaaccaaacctgacaagtacgacgacaatttactgctgcgtcggtgcgaaggcaggttcaccatctccagagatgattcagagaacgacggcgtatctgacaaatagaacagacctagaaaccgaggacacggccgtgtacttactgtcgaccaggcactccgtacgttattactatttttctagtgtacccg

SEQ ID NO: 59331 - DNA, 575 bp, Homo sapiens
  misc_feature: GYAE6OF01EC48E.26.57.F02.1.454.CMB.1.raw
  modified_base (377)..(377): a, c, t, g, unknown or other
  misc_feature (377)..(377): n is a, c, g, or t
  modified_base (413)..(413): a, c, t, g, unknown or other
  misc_feature (413)..(413): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccgggggggtccctgaaactctcatgtgcaggctctggattcacattcagtgactcggctatatactgggtccgccagtctggccgggaaagggctggagtggcttggccgtattagaaccaaacctgacaagtacgcgacaatttangctgcgtggtgcaaggcaggtcaccatctaccaganatgattcagagaacgacggcgtatctagacaaatacgaacacgaccgtaacgaaaaccgacggacgaccggaccgtacgttacgttactcggtacgaccgacgacctacgttcccgttacgttaactttaacgttattttttacgaggttcggttaaccccg

SEQ ID NO: 59332 - DNA, 544 bp, Homo sapiens
  misc_feature: GYAE6OF01CXXVO.26.57.F02.1.454.CMB.1.raw
  modified_base (378)..(378): a, c, t, g, unknown or other
  misc_feature (378)..(378): n is a, c, g, or t
  modified_base (534)..(534): a, c, t, g, unknown or other
  misc_feature (534)..(534): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggagcttggtccgaggccgggggggtccctgaactctcatgtgcaggctctggattcacattcagtgactcggctatatactgggtccgccagtctggccgggaaagggctggagtggcttggccgtattacgaaccaaacctgacaagtacgcgacaatttangctgcgtcggtgcaaggcaggttcaccgatctccagacgatgattcagagaacacggacgtatctagactaaatgaacacgacctagaaaccgaggacacggccgtacgtagtactgtcgaccagacacgtccgtacgttacttacgtatttttcngttcgtaccg

SEQ ID NO: 59333 - DNA, 580 bp, Homo sapiens
  misc_feature: GYAE6OF01DG5ZF.26.57.F02.1.454.CMB.1.raw
  modified_base (383)..(383): a, c, t, g, unknown or other
  misc_feature (383)..(383): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaactctcatgtgcaggctctggattcacattcagtgactcggctatatacgtggggtccgccagtctggccgggaagggctggagtggcgttggccgtattacgaaccaaacctgacgaagtacgcgaactaatttangtctggtcgtcggttgacaagggcgacggttcacctatcctccagagatagattacagagaacgacggcgtatctagcaaatagaacacgaccgtacgaaaccgaggaccgacggaccgtagtacgttacgtgtacgacgacgactacgtccggttacgttactttacgttattttttaccgaggttcggttacccg

SEQ ID NO: 59334 - DNA, 646 bp, Homo sapiens
  misc_feature: GYAE6OF01BQDO6.26.57.F02.1.454.CMB.1.raw
  modified_base (391)..(391): a, c, t, g, unknown or other
  misc_feature (391)..(391): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggagcttggtccgaggccggggggtcctgaaactctcatgtgcaggctcgtggattcacattcagtgactcggctatatacgtgggtccgccagtcgtggcccgggaaagggctgggagtggcgttcggccgttattaacgaacccaaaccgtgaacaagtacgacgaactaatttangacgtgccggttcggtagaccgaagggcgtaacgggttccaaccctacttaccgtacccgaaggaacgtacttagatttacgaaggaacgaaaccgaccgggtacgttaacgtacgtagacaaagtacgaacacgtaccgtaacgaaaaccgaggaccgacgggtaccgtagtacgttacgtggtacgaccgaagtaccacgttcccgttacgttactttaacgtttagtttttaccgtaggttcggttacccgg

SEQ ID NO: 59335 - DNA, 532 bp, Homo sapiens
  misc_feature: GYAE6OF01AZXXV.26.57.F02.1.454.CMB.1.raw
  modified_base (368)..(368): a, c, t, g, unknown or other
  misc_feature (368)..(368): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgttgctattttaaaaggtgtccagtgtcaggtgcagctggtggagtccgggggagcttggtccagccggggggtccctgaaactctcatgtgcaggctctggattcactattcagtgactcggctatatactgggtccgccagtctggcccgggaaaggctggagtggcttggccgtatagaaccaactgacaagtcgcgaacattangctgacgtcggtgacgaggcacggttcaccgatctcagagatgacttcagagaacgacggacgtatctagacaatagaacacgaccgagaaaccgagacgacggcgtagtacgttacgtcgtcgcacgacacgtctacgtattacgtattttcagttcgtaccg

SEQ ID NO: 59336 - DNA, 552 bp, Homo sapiens
  misc_feature: GYAE6OF01B8H3X.26.57.F02.1.454.CMB.1.raw
  modified_base (298)..(298): a, c, t, g, unknown or other
  misc_feature (298)..(298): n is a, c, g, or t
  modified_base (379)..(379): a, c, t, g, unknown or other
  misc_feature (379)..(379): n is a, c, g, or t
  modified_base (540)..(540): a, c, t, g, unknown or other
  misc_feature (540)..(540): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggagtccgggggaggcttggtccaggccgggggggtccctgaaactctcatgtgcaggctctggattcacattcagtgactcggctatatacngggtccgccagtctgccggggaaggctgggagtggcttggccgtattacgaaccaaacctgacaagtacgcgacaatttangctgcgtcggtgcaaggcaggttcacatctcagagatgattcagagaacgacggacgtactctgacaaatagaacacgaccgtacgaaaacgacggacgacggtaccgtagtacttacgtgtcgaccagacacgtccgtacgtacttacgttatttttcgngttcggtacccg

SEQ ID NO: 59337 - DNA, 612 bp, Homo sapiens
  misc_feature: GYAE6OF01BOW3Z.26.57.F02.1.454.CMB.1.raw
  modified_base (313)..(313): a, c, t, g, unknown or other
  misc_feature (313)..(313): n is a, c, g, or t
  modified_base (603)..(603): a, c, t, g, unknown or other
  misc_feature (603)..(603): n is a, c, g, or t
tcagagactatactcacgaccggtgctcgatttagctcgatatagttgggtttggggctgtgagaggtagctccagcctttgggattcccagctgtctccactcggtgatcggcactgaatacgaagagactcaccatggagtttgggctgagctgggttttccttgttgctattttaaaaggtgttccagtgtcaggtgctagctggtggacggtccggggaggcttggtccgaggccggggggtcctgaaactcgtcatgtgcaggctcgtggattcacattcagtcgactcggctatactacgtgggccnccgagtcctaggccggaaggcgtggagtggcttggaccgtagttacgaacctaaacctgaactaagtacgacgaactaagtttagcgtcgtgtcgtcggtgacgtaacggcgtacggttacaccgtatctaccaagagtagtagtattacgagtacgaacgacggacgtactacgtcgtacgtaagtacgaaccgacgtacccgtaacgaaaccggacgaaccgccgtaccgtacgtaacgttcgtgtaccacgacgacgacgtaccgtcgttacttacgtacttttcgngttacccgg

SEQ ID NO: 59338 - DNA, 566 bp, Homo sapiens
  misc_feature: GYAE6OF01BSKW4.26.57.F02.1.454.CMB.1.raw
  modified_base (380)..(380): a, c, t, g, unknown or other
  misc_feature (380)..(380): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcctgttggctatttaaaaggtgtccagtgtcaggtgcagctggtggagtccgggggagcttggtccagccggggggtccctgaaactctcatgtgcaggctctggattcacattcagtgactcggctatatactgggtccgccagtctggccgggaaagggctggagtggcttggaccgtattagaaccaaccgtgaaccaagtacgacgaactaatttagngctagcgtcggtgcaaggctaggtcaccatctaccagagatagattacgagacgaacgacggcgtatcgtgactaaagtagaacgacgtaccgtaagaaaacccggaggaccgaccggccgtacgtattacgtgtcgacagacacgtccgtacgttacttacgttatttttcgacgttggtacccg

SEQ ID NO: 59339 - DNA, 558 bp, Homo sapiens
  misc_feature: GYAE6OF01DV65W.26.57.F02.1.454.CMB.1.raw
  modified_base (383)..(383): a, c, t, g, unknown or other
  misc_feature (383)..(383): n is a, c, g, or t
  modified_base (546)..(546): a, c, t, g, unknown or other
  misc_feature (546)..(546): n is a, c, g, or t
tcagagactatactcacgaccggtgctcgatttagctcgatatagttgggtttggggctgggagaggagctcaagccttgggattcccagctgtctccactcggtgatcggcactgaatacaagagactcaccatggagtttggctgagctgggttttccttgttgctattttaaaaggtgtccagtgtcaggtgcagctggtggaggtccgggggagcttggtccaggcccggggggtccctgaaactctcatgtgcaggctctggattcacattcagtgactcggctatatactgggtccgcagtctggaccggggaaagggctgggagtggcgttggccgtattacgaaccaaacctgaacaagtacgcgactaatttangctgcgtcggtgcaaggcaggtcaccatctaccagagagtagtattcaagagaaccgacggcgtatctagacaaatagaacagaccgtaggaaaaccgaggaccgacggtccgtagtattactgtcgaccagacacgtccgtacgttattacgttatttttcngttcggtacccg

SEQ ID NO: 59340 - DNA, 602 bp, Homo sapiens
  misc_feature: GYAE6OF01C0K7Q.26.57.F02.1.454.CMB.1.raw
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgttagctatttaaagtgtcagtgtcaggtgcagctggtggagtccgggggagcttggtccaggccggggggtccctgaaactctcatgtgcaggctctggattcacattcagtgactcggactatatactgggtccgcctagtcgtggacccggggtaaaggctgggagtggcttggccgtatacgaacaaacctgacaagtacgcgacaatttangctgcgtcggtncgaaggcacggttcaccatcctaccagagactgtattcgagaagaaccgacggacgtatacctagactaaagtagaaacgacgtacccgtaacggaaaaccggaacgggaccgaacggtcccgttagtacgtttacgtaggttcgaccgaacgaacctacgttacccgttacgttaactttaacgttattttttaccgcggttcggttacccg

SEQ ID NO: 59341 - DNA, 598 bp, Homo sapiens
  misc_feature: GYAE6OF01BJGBT.26.57.F02.1.454.CMB.1.raw
  modified_base (306)..(306): a, c, t, g, unknown or other
  misc_feature (306)..(306): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccgggggggtccctgaaacctctcatgtgcaggctctggattcacattcagtgactcggctatatactgggtccnccagtcgtggaccgggaaagggctgggagtggcttggacccgtattaacgaacccaaacctgaacaacgtacgacgaactaagtttangctgcggtcgngacaggctaggtcaccatctacgagagatcgattcgagaacgacgacggcgtatcacgtacaaagtacgaacacggacctaacggaaaccgacggaccgacgggaccgttagtaacgttacgtgtccgaccgacggaaccacgttacccgttacgtttaacttaccgtttatttttcgtacggttcgtacccg

SEQ ID NO: 59342 - DNA, 542 bp, Homo sapiens
  misc_feature: GYAE6OF01B2X2P.26.57.F02.1.454.CMB.1.raw
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (532)..(532): a, c, t, g, unknown or other
  misc_feature (532)..(532): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccnccagtctgccgggaaaggctggagtggcgttggccgtagttacgaaccaacctgacaagtacgcgaactaatttangctgcgtcggtgcaggcaggtcaccatctacagagatgatcagagaacgacggacgtatcgtagacaatagaacacgaccgtacgaaaccgaggacacggccgtagtacttacgtgtcgacagacacgtccgtacgtacttacgtatttttcngtcgtacccg

SEQ ID NO: 59343 - DNA, 548 bp, Homo sapiens
  misc_feature: GYAE6OF01EUB0N.26.57.F02.1.454.CMB.1.raw
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (394)..(394): a, c, t, g, unknown or other
  misc_feature (394)..(394): n is a, c, g, or t
  modified_base (440)..(440): a, c, t, g, unknown or other
  misc_feature (440)..(440): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtagctattaaagtgtcagtgtcagtgcagctggtggagtccgggggagcttggtccaggccggggggtccctgaaactctcatgtgcagctctggattcacattcagtgactcggctatatcgtgggccgccagtcgtggccgggaaggctggagtggcttgccgtattagaaccaacngacaagacgcgacaatttangtcgtgtcgtcggtgacgaggtcgtagtcactntcacgagtatatagtatacagacgaacgacgtacgtactctacganaatacgaacgacgtacgaacgaacgacgacgacgtacgtagtactacgtacgtcgacacgactacgtacgttacgttacgttacgttagttttacgttcgtcggtacg

SEQ ID NO: 59344 - DNA, 535 bp, Homo sapiens
  misc_feature: GYAE6OF01E09S4.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccgggaaagggctggagtggcttggccgtattagaaccaaacctgacaagtacgcgacaatttangctgcgtcggtgcaaggcaggtcaccatcctcagagatgattcgagagaacgacggcgtatctgacaatacgaacagacctagaaaccgaggacacggccgtgtactactgtcgaccagacactccgtacgtacttacgtatttttctgtggtacccg

SEQ ID NO: 59345 - DNA, 622 bp, Homo sapiens
  misc_feature: GYAE6OF01DWQGI.26.57.F02.1.454.CMB.1.raw
  modified_base (306)..(306): a, c, t, g, unknown or other
  misc_feature (306)..(306): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctgaaacctctcatgtgcaggctcgtggattcacattcagtgactcggctatatacgtcgggtccnccagtcgtggaccgggaaagcgtggagtggtcttggccgtaattacgaaccaaactgaacaagtacgacgactaatttagcgctgccgtcggtgacgaagggcacggttcaccctactctaccgagtagagtagtacttacgaagtaacgaacacggtacgtatcctagacaaagtacgaaactacgaccgtaacggaaaccggacggaaccgaccgggtaccgttagttacgttaccgtaggtccgaccacggtactaccgttccgttaacgtttacgttaaccgtttatttttcgaaggttccggttaacccgg

SEQ ID NO: 59346 - DNA, 592 bp, Homo sapiens
  misc_feature: GYAE6OF01D0HD7.26.57.F02.1.454.CMB.1.raw
  modified_base (390)..(390): a, c, t, g, unknown or other
  misc_feature (390)..(390): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaacctctcatgtgcaggctctggattcgacattcagtgactcggctatatactcgggtccgccagtctggaccgggaagggctggagtggcttggccgtaagttacgaaccaaaccgtgaacaacgtacgacgtaacaatttangctgcgtcggtgacgaaggcacggttcaccactactccagtacgatagtattacagaacgaacgacggtacgtactctgacgaaatacgaacgagaccgtaacgaaaccggaacggacgaccggtaccgtacgtacgttacgtcgtacgaccaggacctacgtccgttacgtactttacgttatttttcgagtcggtacccg

SEQ ID NO: 59347 - DNA, 540 bp, Homo sapiens
  misc_feature: GYAE6OF01DOAJR.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggaggtccggggggaggcttggtccaggccgggggggtccctgaactctcatgtgcaggctctggattcacattcagtgactcggctatatactgggtccgccagtctggccgggaaagggctggagtggcttggccgtattagaaccaaactgacaagtacgcgacaatttatgctgcgtcggtgctaaggcaggttcacctatctccagagatagattcagacgaacgacggcgtatctgacaaatagaacagctaacgaaaccgaggacgacggccgtgtacttactgtcgacagacactccgtacgttacttacgtattttctagtggtacccg

SEQ ID NO: 59348 - DNA, 747 bp, Homo sapiens
  misc_feature: GYAE6OF01DOYFX.26.57.F02.1.454.CMB.1.raw
  modified_base (328)..(328): a, c, t, g, unknown or other
  misc_feature (328)..(328): n is a, c, g, or t
  modified_base (443)..(443): a, c, t, g, unknown or other
  misc_feature (443)..(443): n is a, c, g, or t
tcagagactatactcacgaccggtgctcgatttagctcgatatagttggggtttggggctgggagaggagctccagccttgggagttcccagctgtctccactcggtgatcggcactgaatacaagagactcaccatggaggtttgggctgagcttgggttttccttgttgactattttaaaacggtgtccagtgtcaggtcgcagctgggtggacggtccgggggagtcgttcgggtccgacgggcccgggggggtccctaggaaacctctcatggtgcgaggctcgtggattcacattcagtgactcggctatatacgtgggtccnccagtcgtcggaccggggaaaggcgtgggacgtggtcttgggaccgttaattaacgaaaccaaaccgtgaaccaaagtacgacgtaactaatttagacgctggtccgtcgggtanacgaagggtcgtacggttaccaacgtactaccgtaccgaggaacgtagtacggtaatttacgaacggtaacggaaaccgtaacggtacgtaacgttacgtacgtaactaaacgtaacgaaaccggtaacggtaacccgtaaacgggaaaaacccgggaacgggtaaacccggtaaccgggtacccgggttagttaaacgttaaccgttacggttaccggacccgtaacgtaaccgtacccgttaaccggttacgtttaacgtttaacggtttaccttttttacgtaccggttcggttaccccgg

SEQ ID NO: 59349 - DNA, 685 bp, Homo sapiens
  misc_feature: GYAE6OF01B4YFL.26.57.F02.1.454.CMB.1.raw
  modified_base (179)..(179): a, c, t, g, unknown or other
  misc_feature (179)..(179): n is a, c, g, or t
  modified_base (411)..(411): a, c, t, g, unknown or other
  misc_feature (411)..(411): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctatttaaaggtntcagtgtcaggtgcagctggtggagtccggggaggcttggtccgacggccggggggtcctagaaactctacgagtgtgacgaggctctggtacttacactattcagtgacgtcggactatatacgtggtccgcgagtccgtggaccgggaaggctgggagtcggtcgttaggaccgtaagttaacgaaaccgaaacctagaactaaacgtaccgacgaacttaaagtttacnggtactcggtccggtacggtcgaccgtaagggcgtaacggttccaccgtacgtccgtacgaacggtaagacttagtacgtttacgaagaacggaacgacgggtacgtaacttcgtagactaaagtaagtaaccgtacggtacccgtaaaggaaaacccgacggaaccgtaccggtaccggttacgttacgttacgtacgtaccgaccgaacgtaccgtaccgttacccgttacgttacttaacgtttagtttttaccgacggttccggtacccg

SEQ ID NO: 59350 - DNA, 598 bp, Homo sapiens
  misc_feature: GYAE6OF01D07GO.26.57.F02.1.454.CMB.1.raw
  modified_base (304)..(304): a, c, t, g, unknown or other
  misc_feature (304)..(304): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggaggtccgggggaggcttggtccaggcccggggggtccctgaaactctcatgtgcaggctctggattcacattcagtgactcggctatatactgggtccncagtcgtggccgggaaagggctgggagttgcttggccgttaattacgaacccaaacctgaacaaagtacgacgactaatttagtgctgcgtcggtgcgaaggctaggtaccaccgactctaccagagatgtattacaagacgaacgacggacgtagtctagacaaagtagaaacacgtaccgtacgaaaacccgaggacccgaacggtcccgtagttacgttacgtgtacgaccctaaggaccaaccgttccgttaccgttagtttacgtttactttttcgagttcggtacccg

SEQ ID NO: 59351 - DNA, 581 bp, Homo sapiens
  misc_feature: GYAE6OF01D47G5.26.57.F02.1.454.CMB.1.raw
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
  modified_base (534)..(534): a, c, t, g, unknown or other
  misc_feature (534)..(534): n is a, c, g, or t
  modified_base (569)..(569): a, c, t, g, unknown or other
  misc_feature (569)..(569): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcttgggtccaggccgggggggtccctgaaactctcatgtgcaggctctggattcacattcagtgactcggctatatacgtggggtcccgccgtagtcgtggacccggggaaagggctgggagtggcttgggcgtaattaggaaaccaaacctgaactaagtacgcgaactaatttangctggcgtcggtncgaaggcagtcactatctacagagatgatcgagagaacacggctactcgtgactaaagcgaacagtacctaaggaaaccgacggaccgacggtccgtagtacttaccgtgtcgaccgagtacncgttaccgtacgttaacttacgttatttttaccgngttcggtacccg

SEQ ID NO: 59352 - DNA, 721 bp, Homo sapiens
  misc_feature: GYAE6OF01COYLS.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctggtggaggtccgggggagcgttggtccgaggtccggggggtccctagaactctcagtgtgcgaggtctcgtaggtattaccatagttccgagtcgacgtcggtactatacgtaccgtcgggtcccgcctaggtcgtacgggaccgggaaagggtcgtgggaggtcggtcgttacggaccgttaagttaaccgaaaccctaaaccgtagaaaccgtaaacggtacgacgtaaacttaaacgtttagcgtcgtcggtcgttcggtacgacgtaacggcgtacggtaccaacctacgttaccgtaccgtaagtacgtaagttagtattaccgaagtaaacggaacgtacggtacgtacgtacgtacgaactaaagtacgaacgacgtaccgaacgaaaccgacggaccgtacggtaccgttacgtacgttacgtacggtacgtacgaacgtacgtaccgttaccggttaccgtttaacgttaccgttttatttttaccggtaggttcccggttaacccgg

SEQ ID NO: 59353 - DNA, 687 bp, Homo sapiens
  misc_feature: GYAE6OF01CLSX6.26.57.F02.1.454.CMB.1.raw
  modified_base (432)..(432): a, c, t, g, unknown or other
  misc_feature (432)..(432): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttgggctgagctgggtttccttgttgcttatttaaaaggtgtccagtgtcgaggtgcagctggtggaggtccgggggagtcttggtccgagggccggggggtccctggaactctcatgtgcaggctcgtggattcgactattcagtcgacgtcggacttatacgtacgtcgggtcccgcctaggtccgtaggacccggggaaagggccgtagggaggttcgggcgtttcgggaccgttaagttaacgaaaccctaaaccgtgaaaccgtaagtaccgacgtaactaagtttangcgtgtcgtcggtagacgaacggcgtacggttacacctactcctaccgaagagtatagtacttacgaagaacgaacgacggtacgtactacgtagactaaaagtcgaacgacgaccgtaacgaaaaccggaacggaccgaccgggtacgttacgtaacgttacgtacggtacgaccgaacggtaacctaccggttacccggttaacgtttaacgtttaacgtttagtttttacggtacgttcccggttaacccgg

SEQ ID NO: 59354 - DNA, 636 bp, Homo sapiens
  misc_feature: GYAE6OF01CW00I.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggagcttggtccgaggccggggggtccctgaaactctcatgtgcaggctctggattcacattcagtgactcggctatatacgtcgggtccgccagtctggaccgggaaagggctaggagtggcgttggccgtaattaacgaacctaaacctgaacaagtacgcgaactaattagcgtactgcgtcggtgacgtaagggctacggtcaaccgtactaccgtacccagacgaattacggtacttacgaaggaacgaaacgacggtacgttactacgtacgaactaaagtacgaaacgacgtaccgtaaacggaaaaccgtagggaaccgacggtaccggttacgtaacgttacgtacggtacgaccgaagtaccacgttacccgttacgttacttacgttatttttacgaggttccgttaacccg

SEQ ID NO: 59355 - DNA, 570 bp, Homo sapiens
  misc_feature: GYAE6OF01B8GNR.26.57.F02.1.454.CMB.1.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggttatcggcactgaatacaagagactcaccatggagtttgggctgagctgggttttccttgttgctattttaaaaggtgtccagtgtcaggtgcagctggtggaggtccgggggaggcttggtccaggccgggggggtcctgaaactctcatgtgcaggctcgtggattcacattcagtgactcggctatatactgggtccnccagtctcggccggggaaaggctggagtggcttggccgtatacgaaccaactgacaagtacgcgataatttangctgcgtcggtgcgaaggcaggtcaccatcctccagagatagattcgagagaacgacggtacgtatcgagacaagtgaacacgacctagaaaccgacggaacgacggaccgtagtacgttacgtgtacgaccgagaactacgttccgtacgttacgttacgttactttttacgacggttcggtccctacggg

SEQ ID NO: 59356 - DNA, 815 bp, Homo sapiens
  misc_feature: GYAE6OF01BZQS8.26.57.F02.1.454.CMB.1.raw
  modified_base (306)..(306): a, c, t, g, unknown or other
  misc_feature (306)..(306): n is a, c, g, or t
  modified_base (384)..(384): a, c, t, g, unknown or other
  misc_feature (384)..(384): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctggaaactctcatgtgcaggctcgtggattcacattcagtgactcggctatatacgtgggtcccnccagtcctgaccgggaaggtctggagtggcttggcctatacgaaccaaaccgtgacaagtacgacgtaacaactttancgacctggccggttacggtgaccgtaaagggccgacgggtttaccaacccgtaacttccgttacccgtaaggaacgtaacgttacgggtaactttacccgaaaggtaaacggaaaaccggtaacccgggtaaccggtttaaacgttaccgttaacgggtaaccgtaaaaacgtttaaccggaaaaccgtaaaccgggtaaccccggtttaaaaccgggtaaaaaaaccccggggaaaccgggtaaaacccggtaaaccccgggggtaacccgggtttaacgggtttaaaccgtttaaacccggttacgggttaccggaacccgtaaacgggtaacccgtaccgtttaaccccgggtttaacccggtttaaacgttttaaaccggtttaacgtttttttaaccgaacgggttttcccggtttaaaccccggg

SEQ ID NO: 59357 - DNA, 641 bp, Homo sapiens
  misc_feature: GYAE6OF01BO9QJ.26.57.F02.1.454.CMB.1.raw
  modified_base (236)..(236): a, c, t, g, unknown or other
  misc_feature (236)..(236): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtagctatttaaagtgtccagtgtcaggtgcagctggtggagtccgggggagcttggtccaggccggggggtccngaaactctcatgtgcaggctctggattcactattcagtgacgtcggtctatatacgtggtccgccagtctggccgggaaaggcgtgggagtggtcgttcggcgtattacgaaccaaccgtgacgaagtacgcgactaattatgctgcgtcggtgacgaaggtcgtaggttcaccatctccgagaagatagtacttcgaagtaacgaaaccgcggactagtcgtacgtacgtaaacgtacgaaacgacgtaccgtaacgaaaccggtacggaccgaaccgggtcccggttagttaaccgttaccgtaggttaccgaccctaacggtaaaccgtacgttacccggttaccgttaaacgtttaacggttttaaccttttttcgggtacggttccgggtttaaccccgg

SEQ ID NO: 59358 - DNA, 583 bp, Homo sapiens
  misc_feature: GYAE6OF01B3EJV.26.57.F02.1.454.CMB.1.raw
  modified_base (387)..(387): a, c, t, g, unknown or other
  misc_feature (387)..(387): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcgttggtccaggccggggggtccctgaaacctctcatgtgcaggctctggattcacattcagtgactcggctatatactgggtccgccagtctggaccgggaagggctgggagtggcttggccgtattaacgaaccaaaccgtgaacgaagtacgacgaactaatttangtctgcgtggtgcgaaggcgagttcgaccatctcagagatgtattcagacgaacgacggacgtagtcagacaaatagaacacgtaccgtaacggaaaaccgacggaccgaccggacgtacgttacttacgtagtcgacgaacgaccgacgttaccgttacgttactttacgttactttttacgtgttcggtacccg

SEQ ID NO: 59359 - DNA, 664 bp, Homo sapiens
  misc_feature: GYAE6OF01DI2SO.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgttgctatttaaaggtgtccagtgtcaggtgcagctggtggagtccgggggagcttggtccaggccggggggtccctgaaactctcatgtgcaggctctggattcacattcagtgactcggactatatacgtgggtccgccagtctggaccgggaaagggcgtggagtggcttggaccgtaattacgaaccaaacctgaacaaagtacgacgtaactaatttagngtacgtgcggttcggtagacaaagggctacgggttaccacctacgtcctaccgaagaagtaatagtacttacgaggaacgaacgacggtaccgttaactacgtagaactaaaagtacgaaacgaccgtaaccgtaaagggaaaacccgtacgggaaccgaccgggtaccgtaacggttacgttaacgtcggttaccgaccgtaacggacctaacgtacccggttaacgttaacgttttaaccggttaattttttaccgtaaggttccggttaaccccgg

SEQ ID NO: 59360 - DNA, 566 bp, Homo sapiens
  misc_feature: GYAE6OF01CMOJ8.26.57.F02.1.454.CMB.1.raw
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (524)..(524): a, c, t, g, unknown or other
  misc_feature (524)..(524): n is a, c, g, or t
  modified_base (556)..(556): a, c, t, g, unknown or other
  misc_feature (556)..(556): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtgggaggtccgggggaggcgttgggtccgacgggcccgggggggtccctaggaaacctctcatgtgcaggctctggattcacattcagtgactcggctatatacgtgggtcccgccagtctggacccgggaaaggctggagtggcttggcgtattacgaaccaaacctgaacaagtacgcgactaattangactgcgtcggtncgaaggtcacggttacacactctaccagagatagattcgaagaacgaacgacggacgtatctagacaaatacgaacacgacctacgaaacgacggacgacggccgtagtatactgcncagacacgtcgtacgttacttacgtattttcngttcgtaccg

SEQ ID NO: 59361 - DNA, 750 bp, Homo sapiens
  misc_feature: GYAE6OF01B5BMS.26.57.F02.1.454.CMB.1.raw
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggtttttccttgttgcttattttaaaaggtgtccagtgtcaggtgcagcgtggtgggaggtccgggggaggtcgttggtccgacgggcccgggggggttcctaggaaacctcgtcagtgtgcaggctcgtggattcactattcagtgactcggntatatactgggtccncaggtcctggacccggggaaagggccgtagggagtgggtcgttcgggtaccgttagttaacgaaacccgtaaacgttcgaacgtaaacggtacgaccgtaacttaaaatttgcggtcgtgccggttacggtgaccgtaagggtcctacgggttaccaaccgtacgttaccgtacccgaaggacgtaagttagtacgtttacgaaggaaacggtaaccgtacggtaccggttaactcgtaacggtaacaaagtacgaaacccggtacggtacccgtaaacggtaaaacccggacgggtaacccgaaccgggtaccggttacgttaaacgtttaccgtacgggtaccgaccgtaacggacttacccggtaaccgtttccggttaactttttacggttaactttttacggtcggttaaccggttacccgg

SEQ ID NO: 59362 - DNA, 548 bp, Homo sapiens
  misc_feature: GYAE6OF01AQ3OL.26.57.F02.1.454.CMB.1.raw
  modified_base (308)..(308): a, c, t, g, unknown or other
  misc_feature (308)..(308): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtcctgaaactctcatgtgcaggctctggattcacattcagtgactcggctatatacgtgggtccgcagtcnggaccgggaaggctggagtggcttggcctattacgaaccaacgtgacaagtacgcgaacaatttangctgcgtggtnacaaggcaggtcaccatctccagagatgatcagagaacgacggactatctagacaaatacgaacagtacctaagaaaccgacggacgaccggtacgtagtacttacgtgtcgaccagacacgtccgtacgttacttaacgttattttcgtagtcggttacccg

SEQ ID NO: 59363 - DNA, 666 bp, Homo sapiens
  misc_feature: GYAE6OF01C9B9J.26.57.F02.1.454.CMB.1.raw
  modified_base (392)..(392): a, c, t, g, unknown or other
  misc_feature (392)..(392): n is a, c, g, or t
tcagagactatactcacgaccggtgctcgatttagctcgatatagttgggtttggggatgggagaggagctccagccttgggattcccagctgtctccactcggtgatcggcactgaatacaagagactcaccatggagtttgggctgagctgggttttcctgttgctattttaaaggtgtccagtgtcaggtgcagctggtggagtccgggggagcttggccgaggccgggggtccctagaactctcatgtgcaggctctggattcacattcagttgactcggactatactacgtgggtcccgccagtcgtcggccgggaaagggctggaggtggcgttgggccgtaagttaacgaaccgaaacctgaacaagtacgacgactaattacgngcgtcgtcggtcgtggacgaaggtcgtacggttccaaccgtactaccgtacgagacgtatacgtatacgaagaacgtaaccgaggtaccgttagtacgtagtaacgtaaagtacgaaacgtacgtacccgaaacggtaaaccggacggacgtaaccgggtaccgttagtaaccgtttacgtacgttccgaaccgtacgtaaccgttacgttacccgttacggtttaacgtttaaccggttttactttttaacgcggtttccggttaaccccggg

SEQ ID NO: 59364 - DNA, 585 bp, Homo sapiens
  misc_feature: GYAE6OF01ELDRV.26.57.F02.1.454.CMB.1.raw
  modified_base (314)..(314): a, c, t, g, unknown or other
  misc_feature (314)..(314): n is a, c, g, or t
  modified_base (387)..(387): a, c, t, g, unknown or other
  misc_feature (387)..(387): n is a, c, g, or t
tcagagactatactcacgaccggtgctcgatttagctcgatatagttgggtttggggctgggagaggagctccagccttgggattcccagctgtctccactcggtgatcagaactgaatacaagagactcaccatggagtttgggctgagctgggttttccttgttgctattttaaaggtgtccagtgtcaggtgcagctgggtgggaggtccggggggaggcgttggtccgaggcccggggggggtccctggaaactctcatgtgcaggctcgtggattcacattcagtgactcggctatatactggggtccncagtctggccgggaaagggctgggagtggcttggccgtattacgaaccaactgacaagtacgcgacaatttangctgcgtcggtgacgaaggcaggttcaccatcctacagagatgattacgagacgaacgacggcgtatctagacaaagtagaaccgagaccgtacggaaaaccggaggaaccgacgggccgttagtacttaacgtggttcgaccaggacacgttaccggtacgttaacttacgttattttttacgtggttcgtacccgg

SEQ ID NO: 59365 - DNA, 532 bp, Homo sapiens
  misc_feature: GYAE6OF01BT90N.26.57.F02.1.454.CMB.1.raw
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
  modified_base (486)..(486): a, c, t, g, unknown or other
  misc_feature (486)..(486): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccaggccggggggtccctgaaactctcatgtgcaggctctggattcacattcagtgactcggctatatactgggtccgccagtctggccgggaaggctggagtggcttggccgtattagaaccaactgacaagtacgcgacaatttangctgcgtggtgcaaggcagtcaccatctcaganatgattcagagaacgacggcgtatctagacaaatgaacacgacctagaaaccgaggacaccggaccgtagtattactgtcncagacactccgtacgttacttacgttatttttcagttcggtacccg

SEQ ID NO: 59366 - DNA, 638 bp, Homo sapiens
  misc_feature: GYAE6OF01CXV5Z.26.57.F02.1.454.CMB.1.raw
  modified_base (180)..(180): a, c, t, g, unknown or other
  misc_feature (180)..(180): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggngtccagtgtcaggtgcagctgggtggaggtccgggggagcgttgggtccgagggccgggggggtccctaggaaacctcgtcagtgtgcaggctcgtggattcactattcgaagttgaaccgtcggactagtactacgtcgggtaccgccgtaagtcgtcggaccggggaaagggcgtgggagtggcgttggaccgtaattacgaaaccaaacctgaacaaacgtacgacgtactaatttagngctggcgtcggngaccgtaaggctacggttcaaccgtatcctaccgaagaacgtaatcggtaattaccgaaaggaacgaaaccgtacggaccgttaactcgtagaactaaagtaacgaacgaacgtaccaacggaaacgaacggacgacgtaccgtagtattacgcgtcacgacgacacgtcgtacgttacttacgttattttcaggttcgtaccg

SEQ ID NO: 59367 - DNA, 735 bp, Homo sapiens
  misc_feature: GYAE6OF01CR3WX.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgtgggttttccttgttgctaattttaaaaggtgtccagtgtcaggtgcagcgtggtggaggtccgggggagtcgttggtccgaggccggggggtccctaggaaactctcagtgtagcaggctcgtggtattcactattacgaggtcgacgtcggactatacgtacgtcgggtccgacctaaggtcgtacggaccgggaagggtcgtgggaggttcggtccgttacgggtaccgttaaagttaaccgaaaacccgtaaaccgttacggaaacgaaacggttaaccggcgtaaaccgtaaatttacgtcgccgttagtacgggttacggtacgaccgaacggggtacgtaacggttaccgaacctacgtaccctacgaacgtagtagtagtaacgttacgaacggaaacgtaaaccggaccggacgttaactcgtaacgaactaaacgtaacgaacgtaccgaaccgtaaacggaaacgaacggtacgaccggtacgttacgtacttacgtcggtaccgacgaagtaccgtacgtcccggttaacgttacgtttaacgtttacttttacgacggttcgtaaccgg

SEQ ID NO: 59368 - DNA, 558 bp, Homo sapiens
  misc_feature: GYAE6OF01BY9I3.26.57.F02.1.454.CMB.1.raw
  modified_base (274)..(274): a, c, t, g, unknown or other
  misc_feature (274)..(274): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttgggctgagcgtggtttcgtgttagctatttaaaagtgtcagtgtcaggtgcagctggtggagtccggggaggcttggtccagccggggggtccctgaaactctcatgtgcaggctctggattcacattcagtnactcggctatatactgggtccgccaggtctgccggggaaaggcctggagtggcttggccgtattacgaacaaacctgacaagtcgcgaacatttatgctgcgtcggtgcaaggctaggttcaccagtctaccagagatgattacagacgaacacggcgtatctgacgaaatagaactacgaccgtaagaaacccgaggaaccgaccggaccgtagtattaaccgtgtacggaccaggtacacgttaccgtacgttacttacgttatttttctgttcggttaccc

SEQ ID NO: 59369 - DNA, 698 bp, Homo sapiens
  misc_feature: GYAE6OF01D8Y57.26.57.F02.1.454.CMB.1.raw
  modified_base (333)..(333): a, c, t, g, unknown or other
  misc_feature (333)..(333): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgtcttaattttaaaaggtgtccagtgtcaggtgcagcgtgggtgggaggtccgggggaggtcgttggtccgagggtccccgggggggtccctaggaaactctacagtgtgcgaggctcgtggattcaactattcagtcgactcggactatatacgtcgggtcccncgtacgttcgtacgggacccggggaaagggccgtggggaggttcgggtcttacgggaccgttaaagttaacgaaacccaaaccgtacgaacgaacgtacggacgaacgttaatttagtgcgtagccggttcggtgacgtaaggctacggttccaactactactaccgagtagatagtatacgagaacgaaccgacggtacgttagtcgtagaacaaagtacgaacgaacgtaccgtaaacgaaaaccgggacgaaccgaaccgggtcgttagttacgttaaccgtgtaccgaccgtaacgaccgttacgttcccggttacgtttaacgtttacgtttaagtttttacgtcgttccgggtaacccg

SEQ ID NO: 59370 - DNA, 602 bp, Homo sapiens
  misc_feature: GYAE6OF01DO8KI.26.57.F02.1.454.CMB.1.raw
  modified_base (393)..(393): a, c, t, g, unknown or other
  misc_feature (393)..(393): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggagcttggtccaggccggggggtccctgaaactctcatgtgcaggctctggattcactattcagtgactcggctatatacgtgggtccgcctagtcgtggaccggggaaagggcgtgggaggtggcgttggccgtattacgaaacctaacgtgaacaagtacgacgaactaatttangtactgccgtcggtgaccgaagggcgtacggttaccaccactctacagagatgattcgagaacgaacgacggtactacgtctagacaaatacgaacgacgaccgtaacgaaaaccggacggaccgacgggaccgtagtacgttacgtacgtcgaccgacgacctacgttaccgtacgttattacgttatttttacgtgttcggtacccg

SEQ ID NO: 59371 - DNA, 713 bp, Homo sapiens
  misc_feature: GYAE6OF01DPET4.26.57.F02.1.454.CMB.1.raw
  modified_base (321)..(321): a, c, t, g, unknown or other
  misc_feature (321)..(321): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaggtgtccagtgtcaggtgcagctgggtggaggtccgggggaggcgttgggtccgacgggcccgggggggtccctggaaactcgtcatgtgcaggctgtggattcactattcgagtcgactcggactatactacgtggggtccnccgagtcgtaggaccgggaaagggcgtgggagtggtcgttgggtcccgtaagttaacgaaccaaaccgtgaacgaagtacgcgaactaatttancgctcgcggtcggngacgaaggctacggttaccacctactacgtacctaaggacgtaagtgacgttacgaggaacgaacgacggacgttagtacgtagaacgtaaatacggaaaccgtaacgaaccgtaaccggaaaaacccggaacgggtaaccgaacccgggtacccgggttaacgttaacgtttaaccggtacggttacggacccgtaacggtaaccctaacgttacccggtttaccgtttaacgtttaaccggttttacgtttttttaccgtaccggtttccggttaaccccgg

SEQ ID NO: 59372 - DNA, 727 bp, Homo sapiens
  misc_feature: GYAE6OF01A7TYR.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggagtccgggggagcttggtccgaggccggggggtcctgaactctcgatgtgcaggctctggattcactattcagtgactcggctatatacgtgggtccgcagtctggaccgggaaaggctaggacgtggcttggccgtattacgaaccaaccgtgaactaagtacgacgtaactaatttacgcgtacttcggcggttacggtacgacgtaaacgggcgtaacgggttaccaaccgtacgttccgtaacccgaaggaacggtaacgtacggtaacgttcgaaggtaaccgtaaacgaaccgggtaccgttaacgttaccgtaacggtaacgtaaaacgttacggaaaccgtacgtaacccgttaaccgggaaaaccggtacggaacccggtaacccgggtaccggttacgtaaaccgtttaaccgtaccggtacgtaacccgaaggtaacccgtaacgttacccggttaccgtttaaacgtttacgtttaacgttttttacgtaacgggtttcggttaaccccgg

SEQ ID NO: 59373 - DNA, 634 bp, Homo sapiens
  misc_feature: GYAE6OF01DQ85T.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtgggaggtccgggggaggcgttggtccgagggccgggggggtccctgaaactctcatgtgcaggctctggatttcacatttcagtgactcggctatactacgtggggtacccgccgagtccgtaggacccgggggaaagggccgtgggaggtgggtccgttgggacccgttagttaacggaaacctaaaccgtgaaccaaaggttacgaccggaactaaatttagtggttagcgttcgggtagacgaagggcgtacggttacaccgtactccgtccgaagagtagtgtattacgaagtacgaacgtacggacgtaatctagacaaagtagaacagacctagaaaccggagaccgacggaccgtagtacttacgtgtacgctacgactacgtccgtagttacttacgtttattttcagtgtcccgtagg

SEQ ID NO: 59374 - DNA, 741 bp, Homo sapiens
  misc_feature: GYAE6OF01E1639.26.57.F02.1.454.CMB.1.raw
  modified_base (218)..(218): a, c, t, g, unknown or other
  misc_feature (218)..(218): n is a, c, g, or t
  modified_base (384)..(384): a, c, t, g, unknown or other
  misc_feature (384)..(384): n is a, c, g, or t
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
tcagagactatactcacgaccggtgctcgatttagctcgatatagttgggtttggggtctgggagaggagcctcccagccttgggattcccagcctgtcgtcccgactcggtgatcggcgactcgtaagttacggaagagactcaccatccggagtttggctgaagcggtcgttccgtcgtacggcgtacttaaagtgtcgagtcgtagtgtgcgagngtaggtaggacggtaccgggcgtcgtcgtcgaggtccggggtacctcgtaacctcgactagtcgtcgtacggtaacgtcctttaccgtacgtacgttgtaacctacgttaacgtggggtcaccgttacgaccgttacccgttaaggtaaccggttacgggttaccnccgggtaagtttcgggtacggtaccgggggaaagtccggttaaggccgtagggtaccttaacgtaaaccgttaaattaaaccgaaccctaaaccgaagtaacgtaaacgttcggaacctaagtaagtttacgccggagtacggtacgtacggtacaacgtacggacgtacgtacacctacgtaccgacgagacgacgtacgtacctaagacggtaaggtaacgtacggacgtnacggtanacgtaacgtacaacgtccgaaccgtacgaaccgtacgactacgcgtagtaccgagttaggactagtaatcgtacgttacgacgttacgtacgttaacgtttacgaccgtccggtacc

SEQ ID NO: 59375 - DNA, 558 bp, Homo sapiens
  misc_feature: GYAE6OF01EQ2P8.26.57.F02.1.454.CMB.1.raw
  modified_base (508)..(508): a, c, t, g, unknown or other
  misc_feature (508)..(508): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccggggggaggcttggtccgaggccgggggggtccctgaaactctcatgtgcaggctctggattcacattcagtgactcggctatatactgggtccgccagtcgtggccggggaaagggctggagtggcttggccgtattagaaccaaactgacaagtacgcgactaatttatgctcgcgtcggtgacgaaggcaggttcaccactctccagagatgatcgagagaacgacggtacgtatcgtagacaaatagaacacgacctaagaaaccgaggacacggcgtacgtatacgtgtcncgagactacgtccgttacgtacgttacgttatttttctgttcggtacccg

SEQ ID NO: 59376 - DNA, 700 bp, Homo sapiens
  misc_feature: GYAE6OF01CF1SZ.26.57.F02.1.454.CMB.1.raw
  modified_base (132)..(132): a, c, t, g, unknown or other
  misc_feature (132)..(132): n is a, c, g, or t
  modified_base (405)..(405): a, c, t, g, unknown or other
  misc_feature (405)..(405): n is a, c, g, or t
tcagagactatactcacgaccggtgctcgatttagctcgatatagttgggtttgggggctgggagaggagctcccagccttgggattcccagctgtctccactcggtgatcggcactgaatacaagagactnaccatggagtttgggctgagctgggttttcctgttgctattttaaaaggtgtccagtgtcaggtgcagctggtgggagtccgggggagcgttggtccaggcccgggggggtccctgaaactctcatgtgcaggtctctggattcactattcagtgacgtcggctatatacgtgggtccgcagtcgtaggaccgggaaaggcgtggaggtcggtcttgggccgttaagttaacgaaaccctaacctgaacaaggtaccgacgaactaatttagngtctggtcgtcggtgacgaaggtcgtaggtccaccgtactcctacgagaagtagtatacgttacgaaggaacgaaccggaccggtacgttaactcgtaacgacgtaaacgtacgaaacgaccgtaaccgtaaaaccgaaacccgggacggaacccggtaaccgggtccggttaacgttaaacgtttacggttccggtaaccggtaccgtaaacggtaccttaccggttacccggtttaacgtttaacgtttaacgtttaccggttttttacgtaccggttccggttaaccccggg

SEQ ID NO: 59377 - DNA, 661 bp, Homo sapiens
  misc_feature: GYAE6OF01C5RGG.26.57.F02.1.454.CMB.1.raw
  modified_base (396)..(396): a, c, t, g, unknown or other
  misc_feature (396)..(396): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccgggggggtcccctaggaaacctctcatgtgcgaggctctggattcacattcagtgactcggctatatactcgggtccgccagtcgtggaccgggaaagggctgggagtggcgttcggccgtattacgaaccaaacctgaacaagtacgacgtaactaatttangtctgtcgtcggtgacgaaggcgtacggttacacctatcctaccgagagatagagttacgaaggaacgaaccgacggtacgtactacgtacgacgtaaagtacgaacgtaacgtacccgtaacgaaaaccggaacggaccgtaaccggtacccggttagttacgtttaacgtcggttacgacccgtaacggacctaccgtttacccgttaacggtttaacgtttaacgtttactttttttaccgtacgggtttccggttaccccg

SEQ ID NO: 59378 - DNA, 574 bp, Homo sapiens
  misc_feature: GYAE6OF01EPRJZ.26.57.F02.1.454.CMB.1.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggagcttggtccgaggccggggggtccctgaaactctcatgtgcaggctcgtggattcactattcagtgactcggctatatactgggtccnccagtctggccgggaagggctggagtggcttggccgtattacgaaccaactgaacaagtacgcgactaatttangctagcgtcggtgacgaacgggctaggttacaccgactctaccgagacgatgacttcagacgaacgacggcgtatctgacaatacgaacacgacctacgaaaccgagaccgacggtccgtagttacttacgtcgtcgaccagactacgtcccgttacgttaactttacgttatttttacgcgttcggttacccg

SEQ ID NO: 59379 - DNA, 553 bp, Homo sapiens
  misc_feature: GYAE6OF01A0SEQ.26.57.F02.1.454.CMB.1.raw
  modified_base (366)..(366): a, c, t, g, unknown or other
  misc_feature (366)..(366): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctatttaaaaggtgtccagtgtcaggtgcagctggtggagtccgggggagctggtccaggccggggggtccctgaactcgtcatgtgcaggctctggattcacattcagtcgactcggctatatactgggtccgcagtctagccggaaggctggagtgcttggcgtatagaaccaacctgacaagtacgcgacaatttangctgcgtcggtgacgaggcagttcacatctccagagatgattcgaagagaacgacggactatcgtagactaaagtgaacgagtaccgtaacgaaaccgaggaccgacggccgtagtacgttactagtcgccaaggacctacgtcccgttacgtaacgttacgttaagtttttcaggttcggtacccg

SEQ ID NO: 59380 - DNA, 843 bp, Homo sapiens
  misc_feature: GYAE6OF01E5UFF.26.57.F02.1.454.CMB.1.raw
  modified_base (738)..(738): a, c, t, g, unknown or other
  misc_feature (738)..(738): n is a, c, g, or t
  modified_base (748)..(748): a, c, t, g, unknown or other
  misc_feature (748)..(748): n is a, c, g, or t
  modified_base (761)..(761): a, c, t, g, unknown or other
  misc_feature (761)..(761): n is a, c, g, or t
  modified_base (831)..(831): a, c, t, g, unknown or other
  misc_feature (831)..(831): n is a, c, g, or t
tcagagactatactcacgaccggtgctcgatttagctcgatataggttgggtttggggctgggagaggagctccagccttgggattcccagctgtctccactcggtgatcggcactgaatacaagagactacaccgagtggtaggtttgggctgtacgttcgtttgggttttccttagttagtacgtttaagttttaaaaggtcgtccgagtgtcgaggtgcgtaggtcggtggggtgggacggggtccgggggacgtcggttccgggtaccggaccggggtcccgggggtacctacggtaacctcgtacgtgttggtcgacgtacggtcttacgtacgtacttaccgacttacgttcgtacgtcgtaccgtacgtactacgtacggtaccggtccggaccgtcggtacggtacgggtacgggaacggggtacggtaggttacgggtacgttaccggtaccgtaaccggttaaacgtaaaccgtaaaccgtaaacccgtaacgaagtaaccgaacgtaccgtaacgttaactttaaggttcgtcggtacggtcggtacggtacgacggtacgtaacggtacctaccgaacccctagtaccgtaacgacggtaaagttaacgttacgaacggttaaaccgaacgggaacggttaaccccgaaccgggtcttaacgtaaccaacggaaagttaaaccgaccgaaacgacccggtaaccgaaaccgggaaaccggccgttnaacccgggtnttacgttcgaccncgtaacggctaactccggtttaacttccggttaacttttaagtcttttacggtacccgaggttacccggnggttaacccggg

SEQ ID NO: 59381 - DNA, 970 bp, Homo sapiens
  misc_feature: GYAE6OF01CCYQV.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcgttggtccaggccggggggtccctagaaactctcatgtgcaggctgtggattcacattcagtgactcggctatatacgtgggtccgcagtctcggaccggggaaagggcgtgggaggtcggtcgttcgggaccgttaagttaaccgaaaccctaaaccgtcgaaccgtaaaggtaccgaccggtaaactaaagttttacgtacggtccgttacgggcggttccgggtacgaccggtaaacggggtccgtaaccgggtttacccaacccgttaaccgttaccgtaccccgaaagggtaaacggtaacgttacggtaaacgttttacccgggaaacgggtaaaaccgggtaaaacccgggtaacccggggtttaaccggtttaaacgttaaccgggttaaccgggtaaacccgtaaaaacggtttaaccgggaaaaaccccgtaaccggggtaaaccccggtttaaaaaccggggaaaaaaccccggggtaaccgggggtaaaccccgggtaaccccgggggttaaacccgggttttaaaccggtttaaaccgttttaacccgggttaacccgggtttaacccggggtaaacccccgtaaaaccggggttaaaccccgttaacccggttttaaacccccgggttttaaacccgggtttttaaaccggtttttttaaacccgggtttttaacccggtttttttttaacccgggttaaacccggggttttacccggggttttaaaccccccggg

SEQ ID NO: 59382 - DNA, 530 bp, Homo sapiens
  misc_feature: GYAE6OF01AV3SC.26.57.F02.1.454.CMB.1.raw
  modified_base (371)..(371): a, c, t, g, unknown or other
  misc_feature (371)..(371): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgcagtctgccgggaaggctggagtggcttggccgtattagaaccaacctgacaagtacgcgacaatttangctgcgtcggtgcaaggcaggttcaccatctccagagatgattcagagaacacggacgtatctgacaaatagaacagacctacgaaaccgaggacacggcgtgtactatgtcacagacactccgtacgtacttacgttatttttcgagttcggtacccg

SEQ ID NO: 59383 - DNA, 879 bp, Homo sapiens
  misc_feature: GYAE6OF01C6LZI.26.57.F02.1.454.CMB.1.raw
tcagagactatactcacgaccggtgctcgatttagctcgatatagttgggtttggggctgggagaggagctccagccttgggattcccagtctgtctccactcggtgatcggcactgaatacaagagactcaccatggagtttgggcttgagtcgttgggttttccttgttgtcttattttaaaaggtgtccagtgtcaggtgcgagcgtggggtggaggtccgggggaggcgttgggtccgaggccgggggtcctaggaactctcatgtgcgagtctcgtggactttcgactattaccagtcgactcgggacttacgtactacggttcgggtccccgaccgtaacggtcgtacgggaccggggtaaacgggtccgttagggacggtagggttaccgttcggggtacccgttaagttaaccggtaaaaccgtaaaaccggttcggaaactaaacggttaaacccgtacggtaacttaaacgtttacgacggttacgtacgggtaccggttacggtacgtaaccgaacggtacctacgggttaccaaccgtaacgtacctaccgaaggtaacgaactagtaacgttactaacggttaacgaaaccgtacggtaaccgttaacgtaccgtaacggtaaccgtaaacgtaacggtaaacccggaacggtaaacccgtaacgggtaaaaacccgttaacgggtaacccgggtaaccgggttaacccggtttaaacggttaaacggtttaacccggtacgggttaaccggtaaccgtaaaccgggtaacctaacccggtttaacccggttaaccggtttaacggttttaaacccgtttagtttttttaacccggttacgggttaacccgggtttaaaccccggg

SEQ ID NO: 59384 - DNA, 653 bp, Homo sapiens
  misc_feature: GYAE6OF01D8LJ9.26.57.F02.1.454.CMB.1.raw
  modified_base (198)..(198): a, c, t, g, unknown or other
  misc_feature (198)..(198): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
tcagagactatactcacgaccggtgctcgatttagctcgatatagttggtttggggctgggagaggagctccagccttgggattcccagctgtctccactcggtgatcggcactgaatacaagagactcaccatggagtttggctgagctgggtttcctgttgctatttaaaggtgtccagtgtcaggtgcagctggnggagtccgggggagcgttggtccaggccggggggtcctggaactctcatgtgcaggctcgtggattcacngttcagtgactcggctatatacgtggtccncgagtctggaccgggtaaggcgtggagtggacgttggacccgtaagttacgaaaccgaaaccgttgaacgtaaagccgtacgaacctaagtttacgtgctgcgtacggtgacgtaacgggctacggttaccaccgtatccgttaacccgaagtagtaagtacggtactttaccggaagtaaacggtaacgtaccgggtacgtaacgtacgtacggaacaaagtaacgaacgtacgaaccgtaacgaaaccgacgaacgaccggtcgtacgtacgttaacgtggtaccgacgacgtacgtacgtaccgttacgttaactttaccgttaactttttcgtacggttccgttaacccgg

SEQ ID NO: 59385 - DNA, 535 bp, Homo sapiens
  misc_feature: GYAE6OF01BEVQ8.26.57.F02.1.454.CMB.1.raw
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (524)..(524): a, c, t, g, unknown or other
  misc_feature (524)..(524): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttcctgttgctatttaaagtgtccagtgtcaggtgcagctggtggagtccgggggaggcttggtccaggccggggggtccctgaaactctcatgtgcaggctctggattcacattcagtgactcggctatatactgggtccgccagtctggccggggaaaggctgggagtggcttggccgtagttacgaaccaaccgtgacaaggtacgcgacaatttanagctgcgtcggtncgaaggcagtcacntctcagagatagatcgagacgaacgacggcgtatctgacaatagaacagacctagaaacgaggacacggcgtagtactacgtcgtcgacagacactccgtacgttacttacgttattttcngtcggtacccg

SEQ ID NO: 59386 - DNA, 602 bp, Homo sapiens
  misc_feature: GYAE6OF01D5B0E.26.57.F02.1.454.CMB.1.raw
  modified_base (386)..(386): a, c, t, g, unknown or other
  misc_feature (386)..(386): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttcctgttgctatttaaaggtgtccagtgtcaggtgcagctggtggagtccgggggagcttggtccaggccggggggtcctgaaactcgtcatgtgcaggctctggattcacattcagtgactcggctatagtacgtgggtccgccgagtcgtggaccggggaaaggctgggagtggcttggccgtaagttacgaacccaaactgaacaagtacgacgtaactaatttancgcgtgtccggtcggtagaccgaaggcgtagtccaaccatctaccgagagatgattacgaagaacgaacgacggacgtactctagaactaaagtacgaaacgacgtaccgtaaacgaaaaccggacgacgaccggtccgtagttacgttacgtgtacgaccagtacacgttccgtacgttacgttaacgttatttttcgaggttccggtaacccgg

SEQ ID NO: 59387 - DNA, 779 bp, Homo sapiens
  misc_feature: GYAE6OF01CM3K4.26.57.F02.1.454.CMB.1.raw
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggttttcctgttgctattttaaaaggtgtccagtgtcaggtgcagctggtggaggtccgggggagcgttggtccgagggccgggggggtccctaggaaactcgtcatgtgcaggctcgtggattcacattcagtgactcgntatatacgtgggtccncagtcgtggaccgggaaggcgtggagtgtctggaccgttataacgaaccaacgtagaactaaacggtacgacgtaactaagtttactgtctcggcggttacgggtcgaacgaacgggtccgtacgggttacccaaccgtaccttaccgtacccgaaggtaacggtaagtagtaattacgaacgggaaacgtaaaccgaccggtacgttaacgttacgtaacggaaccgtaaaacgtaacgaaaccgtaaccggtaacccgttaaaacggaaaaaccccgggtaacgggtaaacccggtaacccgggaaccggtttaccggttaaaccggtttaaccgtaccggtacccgaacccggtaaacgtacccggtaacccgtttaccccggtttaaccggtttaaaccggttttaaacccggttttaaagtttttttaccccggttaacgggtttccccgggtttaaaccccggg

SEQ ID NO: 59388 - DNA, 567 bp, Homo sapiens
  misc_feature: GYAE6OF01D1QK8.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggaggtccgggggaggcttggtccgaggcccgggggggtccctgaaactctcatgtgcaggctcgtggattcacattcagtgactcggctatatacgtgggtccgccagtcgtgccgggaaaggctggagtgctggccgtatagaaccaactgaacaagtacgcgactaatttagtgctggcgtcggtgacgaaaggcgtaggtccaccaacgtctaccagagatagattacagacgaacgacggcgtatctagacaaatacgaacacgacgtacgaaaccgaggaccgacggccgtagtagtacgtgtcgtacacgacacgtccgtacgtactttaacgttatttttactagttcggtacccg

SEQ ID NO: 59389 - DNA, 577 bp, Homo sapiens
  misc_feature: GYAE6OF01AR6VA.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggaggtccgggggaggcttggtccgaggcccgggggggtccctggaaactctcatgtgcaggctctggattcacattcagtgactcggctatatactgggtccgccagtctggccggggaaagggctgggagtggcttgggccgtattaagaacccaaactgaacaagtacgcgaactaatttatgctgcgtggtgcgaaggcgaggttcaccatctccagagatgattacagagaacgacggacgtatctagacaaagtagaacacgtaccgtaaggaaaccggaacggaccgacggccgtagttacttacgtcgtcgaccagaccacgttccgtacgttactttacttatttttctggttcggtacccg

SEQ ID NO: 59390 - DNA, 630 bp, Homo sapiens
  misc_feature: GYAE6OF01BBFM2.26.57.F02.1.454.CMB.1.raw
  modified_base (396)..(396): a, c, t, g, unknown or other
  misc_feature (396)..(396): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggagcttgggtccaggccggggggtcctggaaactctcatgtgcaggctcgtggattcgactattcagtgactcggctatatactgggtccgcagtcgtgccgggaaaggctggagtggcttgggcctattacgaaccaactgacaagtacgcgaactaattagtcgactgacggttcggntacgaagggtccagggttccaaccgattccaccgtagagtacgtagattacaggaacgacgacggtcgtatctagacaaagtacgaacgacgtaccgtaaggaaaccgacggaaccacccggtacgtacgttaacgtacgttacggtccgtaccgaaggtaaccctaacgtcccggttaacgttaacgtttaccggtttaacctttttacggtaagggtttccggttaccccgg

SEQ ID NO: 59391 - DNA, 544 bp, Homo sapiens
  misc_feature: GYAE6OF01EG2X5.26.57.F02.1.454.CMB.1.raw
  modified_base (381)..(381): a, c, t, g, unknown or other
  misc_feature (381)..(381): n is a, c, g, or t
  modified_base (533)..(533): a, c, t, g, unknown or other
  misc_feature (533)..(533): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccggggggaggcttggtccaggccgggggggtccctggaaactctcatgtgcaggctctggattcacattcagtgactcggctatatactgggtccgccagtctggccgggaaagggctgggagtggcttggccgtattagaaccaaactgacaagtacgcgacaatttangctgcgtcggtgcaagggcaggttcaccatctccagagatgattcagagaacacggcgtatctgacaaatagaacagaccgtaagaaaccgaggaccgacggccgtagtattactgtcgacagacagtccgtacgtattacgttatttttcngtcggtacccg

SEQ ID NO: 59392 - DNA, 762 bp, Homo sapiens
  misc_feature: GYAE6OF01DICQZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgcttaattttaaaaggtgtccagtgtcgaggtgcagcgtgggtgggagggtccgggggaggtcgttcgggtccgacggggtcccgggggggtccctagaaacctcgtcagtgtgcgaggctcgtggacttcactacttcgaagtcgacctcggactagtagtacgtcgggtcccgccgaggttcgtcggaccgggaaagggcgtagggacggtcgggtcgttgggtacccgttaagtttaaccggaaacctaaaccgtaggaaaccgtaaacggtaccgacgtaactaaagtttagcggtcgtaggtccggttacggtcgtaacgaacgggtccgtacgggttacccaaccgtacgtccgtaccgaaggtaacgtagttacgtaacgttacgaaggtaacgtaaccgacgggtacgtacgtacgtaacgaacgaaagtaacgaacgtaacggtacccgtaaacggaaaccggtaacgggaccgtaaccgggtaccgttagttaacgttacgtcggtacgtaaccgacggtactaccgttaccggttacgtttaacgtttacgtttactttttaccggaggttccgttacccggg

SEQ ID NO: 59393 - DNA, 921 bp, Homo sapiens
  misc_feature: GYAE6OF01EIYPB.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtggaggtccgggggagcgttggtccgagggcccggggggtcctggaaactctcatgtgcaggctcgtggacttcactattcagtgactcggactatatacgtcgggtccgctagtcgtacggaccggggaaagggccggtaggtcgggtcgttcgggacccgttaagttaacggaaaaccctaaaccgttacggaaacctaaacgggtaaccggaaccgtaaaccgttaaagttttacggtacggtccgttcgggtaccgggttacggggttacgaaccggtaaaacggggtccggttaacggggtttacccgtaacccgtaacgtttacccgtaacccggtaaacgggtaacggttaacggttacggttaaacgtttaaccggaaacgggtaaaccggtaaaaccggtaaccggggttaaccggtttaaccgttaccggttaaccggtaaaccgtaaaaacggttaaccggaaaacccgtaaaccgggtaaccccggttaaaaccgggaaaaaaccccgggtaaccggggtaaaccccggtaacccggggttaacccggttaacggtttaaaccgtttacccggttaacggttaccggaacccggtaaacgtaacccggttaaccggtttaccccggttaacggtttaaaccgttttaaaccggtttacgttttttaaccggtaacggtttaccgggttaccccgttaacgggg

SEQ ID NO: 59394 - DNA, 608 bp, Homo sapiens
  misc_feature: GYAE6OF01D8ARA.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcttggtccaggccggggggtccctgaaactctcatgtgcaggctctggtattcactattcagtgactcggctatatacgtgggtccgccagtcgtggccggggaaagggctgggagtggcttggccgttagttacgaaaccaaacctgaacaagtacgacgaactaatttactgactggacgtcggtgacgaaggtctacggttcacccatctaccgagagatgatacgagagaacgacggacgtatctagacaaagtacgaacacgaccgtaacggaaaccgaggaccgacggtccgtagtacgttacgtcggtacgtaccgaacgtactacgttacccgtacgttaacgtttaacgtttagttttttacgaggttcggtacccgg

SEQ ID NO: 59395 - DNA, 555 bp, Homo sapiens
  misc_feature: GYAE6OF01DUK7U.26.57.F02.1.454.CMB.1.raw
  modified_base (377)..(377): a, c, t, g, unknown or other
  misc_feature (377)..(377): n is a, c, g, or t
  modified_base (545)..(545): a, c, t, g, unknown or other
  misc_feature (545)..(545): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccggggggtcctgaaactctcatgtgcaggctctggattcacattcagtgactcggctatatacgtgggtccgcagtctggccgggaaaggctggagtggcttggccgtattagaaccaactgaacaagtacgacgactaatttangtctgcgtcggtgacaaggcgaggttccaccatcctaccagagatgtacttcgagagaaccgacggtacgtatctagacaaagtagaacagcctaagaaacgaggacacggcctagtacttcgtagtcgacagactacgtccgtacgttacttacgttatttttacgngttgtacccg

SEQ ID NO: 59396 - DNA, 600 bp, Homo sapiens
  misc_feature: GYAE6OF01A3KFF.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttatttttaaaggtgtccagtgtcaggtgcagctggtggaggtccgggggaggcttggtccaggcccggggggtcctgaactctcatgtgcgaggctctggattcacattcagtgactcggctatatactgggtccgccagtctggccggggaaagggctgggagtggcgttggccgttaattacgaacccaaacctgaacaagtacgcgaactaatttagtgctgcgtcggtgacgaagggctaggttccacctatcctccagacgagtagtacttacgaggaacgaacgacggtacgttactcgtacgacaaatacgaacgacgtacctaacggaaacccgagaccgaccggccgtacgttacttacgtcgtcgaccaagacacgtccgttacgttaactttacgttatttttacgtgttcggttacccg

SEQ ID NO: 59397 - DNA, 834 bp, Homo sapiens
  misc_feature: GYAE6OF01CLKE2.26.57.F02.1.454.CMB.1.raw
  modified_base (804)..(804): a, c, t, g, unknown or other
  misc_feature (804)..(804): n is a, c, g, or t
  modified_base (816)..(816): a, c, t, g, unknown or other
  misc_feature (816)..(816): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagcttgggttttccttgttgcttattttaaaggtgtccagtgtcaggtgcagctgggtgggaggtccgggggaggcttgggccgaggccgggggggtcctagaactctcatgtgcaggctcgtggacttcactattcgagtcgacgtcggacttaatacgtacggtcggggtccgcctaggttccgtggggacccggggaaaggggtccgttagggacggttgggtcccgtttagggtaccccgttaagtttaaaccggaaaaccctaaaccgtggtaaacgtaaacggttaccggaaccggtaactttaaagttttacgtacggtcgttcgggtaccgggttcggggttagaaccggtaaacggggtccgttaacgggtttacccgaacccgttacgttacccgtaaccgtaaacggtaaggtacgttaacgggtactttaccggaaggaaaccgggtaaccggtaaccgggttacgtaacgttcgtaacgaacgtaaacgtacggaaccgtaacgggtaccctaaacgggtaaaaacccggacgggaaacccggtacgggttacccggttaaggttaaaccgttaccgttcgggtactacccggaaggtaccctaaccgttaccggttaccgtttaaacgtttaacggttttntttttaaccggnggtttcccggtaacccgg

SEQ ID NO: 59398 - DNA, 707 bp, Homo sapiens
  misc_feature: GYAE6OF01C9MCA.26.57.F02.1.454.CMB.1.raw
  modified_base (382)..(382): a, c, t, g, unknown or other
  misc_feature (382)..(382): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggagtccgggggagcttggtccgaggccgggggggtccctgaactctcatgtgcaggctctggattcacattcagtgactcgctatatacgtgggtccgccagtctggccgggaaaggctggagtggcttggccgtattacgaacctaaactgaacaagtacgcgtaactaatttangtctggtcgtcggtagacgaagggcgtagttccacctactcctaccgagtacgagtagacgttacgtaggaacgaaccgaccggtacgttaacgttcgtacgtactaaaagtacggaaaccgtaacggacccgttaaacggaaaaaccccgggaacggggaacccgaacccggggtacccggttaacggttaaccgttttaaccgttacggttaccggaccctaaacgggtaaccctaaccgttaccccggtttaccggtttaaccttttaaaccggtttaccttttttttaacggtaccgggtttaccgggtttaacccccggg

SEQ ID NO: 59399 - DNA, 612 bp, Homo sapiens
  misc_feature: GYAE6OF01EZBRI.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccggggggaggcgttggtccaggcccgggggggtccctaggaaactctcatgtgcaggctctggatttcacattcagtgactcggctatatactgggtccgccagtctggccgggaaagggctggagtgcttggccgtattagaaccaaactgaacaagtacgcgacaatttatgctgcgtcggtgcgaaggcaggttccacctatctaccagagatgatcagacgaacacggcgtatctgacaaatagaacacgaccctaagaaaacccggaggaaccgaccgggaccgtagttaacgttaacgtacggtcgtacccgaacggtacctacgttaccccggttacgtttaacgtttaaccggtttaagtttttttaccgtaggtttcgggttaaccccgg

SEQ ID NO: 59400 - DNA, 644 bp, Homo sapiens
  misc_feature: GYAE6OF01B52VP.26.57.F02.1.454.CMB.1.raw
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
tcagagactatactcacgaccggtgctcgatttagctcgatatagttggggtttgggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggaggcttggtccgaggccggggggtccctgaaactctcatgtgcaggctctggattcacattcaagtgactcggctatatacgtgggtccnccagtctgccgggaaaggctggagtggcttgggccgtattagaaccaaaccgtgacaagtacgacgacaatttangctgcgtggtgcaaggcagtcaccatactcagagatgattccagagaaccgacggacgtactacgtcgacaaagttacgaaccaacggtacccgtaaacggtaaaacccggacgggtaaccgaaccggggtacccggttaacggttaacgttaacccgttcggtaaccgtacccgaacggtaaccctaacgttaccccgttacggttaacgttttaaccggttaacgtttttttaccgaacgggtttcgggttaacccccgg

SEQ ID NO: 59401 - DNA, 740 bp, Homo sapiens
  misc_feature: GYAE6OF01CO3SF.26.57.F02.1.454.CMB.1.raw
  modified_base (404)..(404): a, c, t, g, unknown or other
  misc_feature (404)..(404): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggaggcgttggtccgaggccggggggtccctagaaactctcagtgtgcaggctctggattcactattcgagtcgactcggctatagtacgtgggtcccgccagtcgtggaccggggaaggccgtggagtcggcttgggacctagttacgaacctaaaccgtgaacgaaagtacgacgtaactaagtttcnggtctggtcggtcggtgacgaagggtccgtacggttacctaccgtactaccgtacccgaagaagtagtagtacttacgaacggtaacgaaaccgtacggtaccgttaacgtcgtacgaacgtaaagttaacgaaaccgtaacggtacccgtaaaccggaaaaacccggtaaccgggaaccgtaacccggggttaccgttacggttaacgtttaaccgtacgggttaccggtacccgtaacggtaacccgttaccgttaacccggtttaccggtttaaaccggttttaccgttttaaccgtttttttaccgaacgggtttcccgggtttaaccccgg

SEQ ID NO: 59402 - DNA, 557 bp, Homo sapiens
  misc_feature: GYAE6OF01BBPYM.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttgggtccgaggccgggggggtccctaggaaactctcatgtgcaggctcgtggattcacattcagtgactcggctatatactgggtccgccagtctggaccgggaaggctgggagtggcttggctattacgaaccaactgaacaagtacgcgaactaatttangctgcgtcggtgcgaaggcacggttcacctatctccagagatgtattcagacgaacgacggcgtatctagacaaagtagaacgagaccgtaacgaaacgacggaccgacggcgtagtattacgtgtcgacagtcagtccgtagttacttacgttattttcagttcggtaccg

SEQ ID NO: 59403 - DNA, 576 bp, Homo sapiens
  misc_feature: GYAE6OF01ENAYE.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggaggtccggggggaggcttggtccgaggccgggggggtccctgaaactctcatgtgcaggctctggattcacattcagtgactcggctatatactgggtccgccagtctggccgggaagggcgtgggagtggcttgggccgtattagaaccaaacctgacaagtacgcgaacaatttangctgcgtcggtgacgaaggcaggttcaccatcctccagagatgattcgagagaacgacggcgtatctgacaagtacgaacgacgaccgtaacggaaaccgacggaccgacggccgtagtacgttacgtcggtcgccgaggactacgtcccgttacgttactttacgttatttttcgtaggttcgttacccg

SEQ ID NO: 59404 - DNA, 707 bp, Homo sapiens
  misc_feature: GYAE6OF01AQ9Y3.26.57.F02.1.454.CMB.1.raw
tcagagactatactcacgaccggtgctcgatttagctcgatatagttgggttgggggctgggagaggagctccaggccttgggattcccagctgtctccacctcggtgtatccggcactgaatacaagagactcaccatggagtttcggctgagctggttttcctgttgctattttaaacggtgtccagtgtcaggtgcagctggtggagtccggggagctggtccaggccgggggtcctgaactctcatgtgcaggtctcgtggacttcacattcagtgacctcggactatatacgtgggtccgcctagtctaggaccggggaaaggtccgtagggacgtcggccgttagggcccgttaattaacggaaacccaaaccgttgaacaaacggttacgaccgtaactaacgttttatcggacgttcgaccggttacggtgtaaccgtaacgggcctaagggttaccaaccgtaacgttcccgtaccgaaggaacgtaacgtaggtaacgtacgaagaaacggtaacgtaaccggtcgttaacgtactacgaactaagtacggaaaccgacgaacccttaaacggaaaccgtacggtaccgtaaccgggtccgtaacggttaacgtacgtacggtacgtaccaacggtacctacgtacccgttacgttaacgttacgttaaccttttcggaccggttccgttaacccgg

SEQ ID NO: 59405 - DNA, 545 bp, Homo sapiens
  misc_feature: GYAE6OF01EYWKH.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggagtccggggggaggcttggtccaggccggggggtcctgaaactctcatgtgcaggctctggattcacattcagtgactcggctatatactgggtccgcagtctgccgggaaaggctggagtggcttggccgtattagaaccaacctgacaagtacgacgacaatttangctgcgtcggtgcaaggcaggttcaccatctccagagatgattcagagaacacggcgtaatctgacaagtagaacagacctaagaaaaccgaggacgacggaccgtagtacgttactcgtcgaccagacactaccgtcgttacttacgttatttttcagttcggtacccg

SEQ ID NO: 59406 - DNA, 778 bp, Homo sapiens
  misc_feature: GYAE6OF01CW7HQ.26.57.F02.1.454.CMB.1.raw
  modified_base (208)..(208): a, c, t, g, unknown or other
  misc_feature (208)..(208): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtgggttttccttgttgcttaattttaaaaggtgtccagtgtcaggtgcagcgtggngggaggtccggggagcttggtccgagggcccgggggggtccctagaaactcgtacagttcggtgcgagggcttcgtaggtacttcactacttacgtagtcgaccgtcggacttatacgtacgtcgggtacccgccgtacgtcgtacggacccggggtaaaggtcgtaggacgggttggtaccgttagggtacccgttaaagttaaaccgaaacccgtaaaaccgttccggaaacgtaaacggttaaccggaacgtaacgtttaaacgttttaacgtgtaccgttcggtaccgggttacgggtagacccgtaagggtaccgtacggttaaccaccgtataccgtaacgagaacgtatacgtatacgaacgacgtaaacgcggtacgtagttacacgtaacgaaactaggaaaccgtacgtaacccgaaaggaaaccggtaacggaccgtaaccggtaacgtacggttaacttacgtacggtaccgtacggacgtaaccgtacgttacccggttacgtttaaacgtttaaccggtttaagtttttaaccgtcggttaaccggttaaccccgg

SEQ ID NO: 59407 - DNA, 616 bp, Homo sapiens
  misc_feature: GYAE6OF01DI8TU.26.57.F02.1.454.CMB.1.raw
  modified_base (380)..(380): a, c, t, g, unknown or other
  misc_feature (380)..(380): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggaggtccgggggaggcttggtccgaggccgggggggtccctgaaactctcatgtgcaggctctggattcacattcagtgactcggctatatacgtgggtccgcagtctggccgggaagggctggagtggcttggccgtatacgaaccaactgacaagtacgcgaacaatttangctgcgtcggtgcaaggcaggttcacatctccagacgatagattcagacgaacgacggacgtatctagacaaagtacgaacgacgtaccgtaacgaaaaccggtaacggaccgaccgggtaccgttagttaacgtttacgtacggtcgaccgaacggtaacctaacgttacccgttacggttaaacgttttaaccggtttaacgtttttttccgtaagggttccggttaaccccgg

SEQ ID NO: 59408 - DNA, 531 bp, Homo sapiens
  misc_feature: GYAE6OF01AR3G8.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtcctgaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaggcaggttcacatctcagagatgattcagagaacacggcgtatctagacaaatagaacagaccgtagaaaccgaggacgacggccgtgtacttactgtcgcagacactccgtcgtacttacgtatttttcgagttggtacccg

SEQ ID NO: 59409 - DNA, 894 bp, Homo sapiens
  misc_feature: GYAE6OF01B26F6.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtggaggtccggggggagtcgttcggtccgacggggtcccgggggtacctagtaacctctacgagtgtgacgtaggtccgttcgtggtactttccaactacgttacgaaggttacggtaccgtccgggtactttaagttaacgttaccggttccggggtcccgtaccggtaaggttccggttacggggaacccggggtaaagggtccggtagggtacggttcgggtacgttcgggtaaccgttaagttaaaccggaaaacccgtaaccgtacggaaacctaaacgggtaccgacgtaaacttaagtttacgtcgtcgtacggtccggttcggtacgaacggtacggtaccgttaacggttaccccaaccgttacgtcccctaaccggtaaggtaacgtacgttagtacgttaccgaaggtaaaccgtaaccggtacgggtacgttacgtacgtaacgtaaacggtaaagtaaccgaaacccgtacgggttaaacccgaaaaccggggtaaaaccgggaccggtaaccgtaaccccggggtacggtttaacgtttaaaccggttaccgttacgggtaacccgaacgtaaacccggtacgttacccgtttaacccgggtttacgtttaaacgtttttacccggttttaaaccgttttttcgggtaaccggtttccccgggtttaaacccgg

SEQ ID NO: 59410 - DNA, 768 bp, Homo sapiens
  misc_feature: GYAE6OF01CIZZH.26.57.F02.1.454.CMB.1.raw
tcagagactatactcacgaccggtgctcgatttagctcgatatagttgggtttggggctgggagaggagctccagtcttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggtcttggtccgaggccggggggtccctggaaactctcatgtgcgaggctctggattcactattcagtgactcggactatactacggtcgggtcccgccgtagtcgtcgggaccggggaaagggccgtgggagtgggtcgttgggaccgttaagttaacgaaaccctaaaccgtggaaacctaaaggtaccgacgtaaacttaagtttagtacggtcgtcggtccggtacggtaggaccgaagggtccgtacgttacccacctactcctaaccgaggtaacgtagtagtacgtacgaaggtaacgaacgtacggtacgtaactcgtaacgtaactaaacgtacgaaaccgaacggtaccgttaaaccggggaaaaacccgggtaccgggtaacccggtaaccggggtaccggtttaacggtttaaacgttccggttaacggtaccggtaaccgaaacggtaacccgttaacggttaccccggtttaacggtttaaccgtttaaacggttttacggttttttaaccgcgggtttaccggttaaccccggg

SEQ ID NO: 59411 - DNA, 540 bp, Homo sapiens
  misc_feature: GYAE6OF01CG0HE.26.57.F02.1.454.CMB.1.raw
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
  modified_base (528)..(528): a, c, t, g, unknown or other
  misc_feature (528)..(528): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccnccagtctgccgggaaaggctggagtggcttggccgtattagaaccaacctgacagtacgcgacaatttangctgcgtcggtgcaaggcaggttcaccactctccagagatgattcagagaacgacggcgtatctagacaaatagaacagccgtagaaaccgaggacgacggcgtagtacttacgtgtcgaccagacactccgtacgttattacgttatttttcngttcggtacccg

SEQ ID NO: 59412 - DNA, 621 bp, Homo sapiens
  misc_feature: GYAE6OF01CXOXT.26.57.F02.1.454.CMB.1.raw
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtcccggggggaggcgtttgggtcccgagggcccgggggggtcccctaggaaacctctcatggtgcaggctcgtggattcacattcagtgactcggctatatacgtgggtccgccagtctggaccgggaaagggcgtggagtcggcgttggccgtattaacgaaccaacctgaacaagtacgcgaactaatttngtactggcgtcggtncgaaggcgtaggttccaccatcctacgagagatagactcgaagacgaacgacggcgtatcgtacgacgaaatacgaaacgacgtaccgtaacggaaaaccggaacggacgaaccgggtccgtacgttacttacgtcggtcggaccacgacctacgttacccgtcgttaactttacgtttatttttcgagtttccggtaacccg

SEQ ID NO: 59413 - DNA, 652 bp, Homo sapiens
  misc_feature: GYAE6OF01ETOCD.26.57.F02.1.454.CMB.1.raw
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (504)..(504): a, c, t, g, unknown or other
  misc_feature (504)..(504): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttccttgttgcttaattttaaaaggtgtccagtgtcaggtgcagctgggtggaggtccgggggagcgttggtccgacgggcccgggggggtccctagaaacctctcatgtgcgaggctcgtggattcactattcagtgactcggactatatacgtcgggtccgcgacgtcgtcggaccggggaaagggctgggagtggcgttcggacccgttaagtaacgaaaccaaaccgtgaaaccgaacgtacgacgaaacgtaatttagngactcggcggtcggngacgaaggcgtagttccaccactctacagagagtgactacgaagacgaacgacggcgtactcgtanaacgtaaatagaaccgacgaaccgtaaacggaaaccgacggacgaaccgggtaccgtagttaacgttacgtgtaccgaccagtacctacgttacccgttacgttaactttaacggtttactttttacggacggtttcggttaacccgg

SEQ ID NO: 59414 - DNA, 707 bp, Homo sapiens
  misc_feature: GYAE6OF01C143F.26.57.F02.1.454.CMB.1.raw
  modified_base (185)..(185): a, c, t, g, unknown or other
  misc_feature (185)..(185): n is a, c, g, or t
  modified_base (430)..(430): a, c, t, g, unknown or other
  misc_feature (430)..(430): n is a, c, g, or t
  modified_base (626)..(626): a, c, t, g, unknown or other
  misc_feature (626)..(626): n is a, c, g, or t
tcagagactatactcacgaccggtgctcgatttagctcgatatagttgggtttggggctggggagaaggagcctccaggccttgggacttcccagctgtctccactcggtgatcggcactgaatacaagagtactcaccatggagtttgggctgagctgggtttccttgttgctattttaaaggngtccagtgtcaggtgcagcgtggtggaggtccgggggagtcgttggtccgagggtcccgggggggtccctaggaaacctctcagtgtgcaggtctgtaggtcttcactattcagttgacgtcggactagtacgtacgtgggtcccgctaggtcgtggaccgggaagggcgtggaggtcggtcgttcgggaccttaagtaacgaacctaaaccgtggaacgaaagtacgacgtaactaaagtttangtactggtcggtcggtgacggacggtcgtacgttaccaccgtaactccgtaccgaagtaacgtagtagtaacttacgaaggtaacggaaccgacggtaccggtactaccggtagaacgtaaacgtacggaaaccgacgtaaccgtaaacgtaaacccggacggaccgaaccgggtccgttaagttaacgttaccgngtaccgaccgaacggtctaaccggttacccgttaggttacctttaacggttagttttacccggaggtttccggtacccggg

SEQ ID NO: 59415 - DNA, 714 bp, Homo sapiens
  misc_feature: GYAE6OF01ACMSQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccggggggagtcgttggtccgacgggcccgggggggtccctaggaactctcatgtgcaggctcgtaggtattcactattcagtcgactcggactattacgtacgtcggggtccgccgtagtccgtagggacccgggggaaagggtccgtgggaggttcgggtcgtttagggtacgttattaacggaaaccctaaaccgtgaaccgaaacgtaccggacgtaacgtaatttacgtacggcgttcggtaccgggttcgggttacggaccggtaaaggtccggtaacggttaccaaccctaccgttccgtaccgaaggtaagtacgtagtacgttacgaaggaacgaacgacggtacgtactcgtagaaccaatacggaacacggtaccgtaacgaaaccggacggaccgaccggtcggttacgttacgtacgtcggtacgaccgacgacctacggttaccgttacggttacctttacgtttacgttttcgaggttccggtaacccgg

SEQ ID NO: 59416 - DNA, 691 bp, Homo sapiens
  misc_feature: GYAE6OF01EZEPK.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctgggtggaggtccgggggaggcttgggtccgaggggcccggggggtccctagaaacctctcgatggtgcacggtctcgtggtattcactattcagtgactcggatatatacgtgggtccgccgagtcgtggccgggaaagggctgggagtggcgttggaccgttaagttaacgaaacccaaaccgtggaacaaacggtacgacgtaactaatttatcgtcgtggtccggttcggtgacggtaaggccgtacggttaccaacctatacctaccgaagaagattgaacttacgaacgaacgtaaccgacggtacggttactacgtacgaacaaagtaacgaaacgaccgacgtaaacggaaaacccggtacgaaccggtacccggtaccggtttagtaccgttaacgtcggtaccgtacccgaagtaccgtaccgttcccggttaacgtttactttaacgttttattttaccgtggttaccggttacccg

SEQ ID NO: 59417 - DNA, 613 bp, Homo sapiens
  misc_feature: GYAE6OF01C9CYD.26.57.F02.1.454.CMB.1.raw
  modified_base (401)..(401): a, c, t, g, unknown or other
  misc_feature (401)..(401): n is a, c, g, or t
  modified_base (474)..(474): a, c, t, g, unknown or other
  misc_feature (474)..(474): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctggtggaggtccgggggaggcgttgggtccgacgggtcccggggggggtccctaggaaaccttctcatgtgcgaggtctctgggattcacattcagtgactcggctatatactgggtccgccagtctggccgggaaaggcgtggagtggcgttggccgtaattacgaaccaaacctgaacaagtacgcgacaatttangctgcgtcggtgacaggtcaggtacacgactctcagagatgatgagagaacacggtacgtatctagactaaancgaacacgtacctaacgaaaccgaacggacgaccgggtaccgttacggtaacttacgtacggtacgaccgaaggaacctacgtacccgtttacgttaactttaacgtttacgttttttacacggttcggttaaccccgg

SEQ ID NO: 59418 - DNA, 826 bp, Homo sapiens
  misc_feature: GYAE6OF01ASHS4.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagcgtgggtggaggtccgggggagcttggtccaggccggggggtcctgaaactctcatgtgcaggctcgtggattcactattcagtgacgtcggctagtactacgtcggggtcccgcctaggtccgtcgggacccgggggaaagggcgtagggacggtgggtacgtttcggggtacccgttaagttaaccgtaaaacccctaaaccgttaggaaaccgtaaacggttaacccggaaccgtaaacttaaacgtttttaacggtacggtccgttcgggtaccgggtttcggggtacggaaccgggtaaacggggtccgttaacggggtttacccaaacccgtacgtttacccgtacccgaaagggtacggtaagttaggtaactttaaccggaaagggaaacgaaccggtaaccgggtaccggttaacttccgtaacggaacgtaaaagtaacggaaacctaaccgggtaacccgttaaaccggaaaaccgggtacgggtaacccggtaaccgggtacccgggttaacgtttaacgttacggttacggtaccggacctaacggtaactcccggttaccggttaacgtttaacgttttacgttaactttttcgtaacggttccgttacccgg

SEQ ID NO: 59419 - DNA, 668 bp, Homo sapiens
  misc_feature: GYAE6OF01BQOH0.26.57.F02.1.454.CMB.1.raw
  modified_base (418)..(418): a, c, t, g, unknown or other
  misc_feature (418)..(418): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccgggggaggcttggtccaggcccggggggtcctgaaactctcatgtgcaggctctggattcactattcagtgactcggactatactacgtcgggtccgccgtagtcgtcggaccggggaaagggtcgtgggaggtggtccgttgggacccgttaagttaacgaaacccaaaccgtagaacgaaacggtacgacgaactaatttagnggtctcggtcggtcggtcgacgtaaacgggtcgtacggttccacctactccgtaccaagtagatagtacttacgaagtacgaaccgacggacgtactacgtacgaactaaagtacgaaaccgacgtaacccgtaaacggaaaacccggacggaaccggaccggtaccgttagttacgttacgtggtccgacgacgtacctacgttccgttacgttacgttacgtttattttacgtacgttccggtacccg

SEQ ID NO: 59420 - DNA, 638 bp, Homo sapiens
  misc_feature: GYAE6OF01CRF23.26.57.F02.1.454.CMB.1.raw
  modified_base (414)..(414): a, c, t, g, unknown or other
  misc_feature (414)..(414): n is a, c, g, or t
  modified_base (463)..(463): a, c, t, g, unknown or other
  misc_feature (463)..(463): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgctattttaaaaggtgtccagtgtcaggtgcagctggtggaggtccgggggagcgttggtccgaggccgggggggtccctgaaactctcatgtgcgaggctcgtggacttcactattcagtgactcggacttatatacgtcgggtcccgcctagtctggacccggggaaagggcgtgggagtgggtcgttgggccgtaagttaacgaaaccaaaccgtgaacgaaagtaccgacgaactaatttangtctggcgtggtgacgaaggcgtaggttccacctatcctcgagagatgnttacagaacgaacgacgggctatcgtagacaaagtgaaacgacgaccgtaacggaaaaccggacggaaccgaccggtaccggtagttaattacgtacggtcgacccgacggacctaacgttacccgttacgttactttaacggtttatttttacccgaggtttcggtaaccccgg

SEQ ID NO: 59421 - DNA, 676 bp, Homo sapiens
  misc_feature: GYAE6OF01EYQRN.26.57.F02.1.454.CMB.1.raw
  modified_base (312)..(312): a, c, t, g, unknown or other
  misc_feature (312)..(312): n is a, c, g, or t
  modified_base (388)..(388): a, c, t, g, unknown or other
  misc_feature (388)..(388): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcgttggtccgaggccggggggtcctgaaactctcatgtgcaggctctggattcacattcagtgactcggctatatacgtgggtccgccagtcgnggaccgggaaaggctgggagtggcgttggccgtagttacgaaacccaacgtagacaaagtacgcgaactaatttangtctgcgttcggtgacgaacgggcgtacggttaccaaccctactcctaccgtagaagtagtagtacttacgaagaacggaaaccgacggtaccgtaatcgtacgaacaaacgtaacgaacgaacggtaccgtaaacggaaaacccggaacggaaccgaccgggtaccggttacgtttaacgttaaccgttcggtacgtacccgaacggtaaccgtacgttacccgtttaaccgttaacgttttaacggtttaacgtttttttacgtaacggttccgggttaaccccgg

SEQ ID NO: 59422 - DNA, 650 bp, Homo sapiens
  misc_feature: GYAE6OF01C5YLT.26.57.F02.1.454.CMB.1.raw
  modified_base (306)..(306): a, c, t, g, unknown or other
  misc_feature (306)..(306): n is a, c, g, or t
tcagagactatactcacgaccggtgctcgatttagctcgatatagttgggtttggggctgggagaggagctccagccttgggattcccagctgtctccactcggtgattggcactgaatacaagagactcaccatggagtttgggctgagcgtggtttcctgttgctatttaaaggtgtccagtgtcaggtgcagctggtggagtccgggggaggcttggtccgaggcccggggggtccctgaaactctacatgtgcaggctcgtggacttcacgattcgagtgactcggctatatacgtggtccncgagtcgtggaccgggaaggcgtggagtggtcgttggccgtaagttacgaacctaaacctgaacaagtacgacgtaactaagtttagacgtcgtcggtcggtcggtgacgaacggtcgtacggttaccactactctccgagagatgattacgagaacgaacgacggtacgtagtacgtagactaaagtacgaaaccgacgtaacccgtaacggaaaaccggaacgggaaccgaccgggtacgttacgtacgttaacgtacggtaccgaccgaacggtaacctaccgttaccggttacgtttaacgtttacgtttagtttttacgtacggttccggttaacccgg

SEQ ID NO: 59423 - DNA, 842 bp, Homo sapiens
  misc_feature: GYAE6OF01D5JE8.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagcgtgggtggacggtccggggggagtcgttggtccgagggcccgggggggtcctagaaacctctcatggtgcgaggtctcgtggacttcactattcgagtcgacgtcggtacttaagtacgtacgttcggggtcccgtaccgtaacggttccggtacggggaacccggggggtaaaggggtccgtagggggtacggttcgggtacggtttaccggggtacccggttaaagttaaaccggaaaacccgtaaaccgttacggaaaccgtaaacggtaacccgggaaccgtaaacttaaacgtttttacggtacggtaccggttacgggtaccgggtttacgggtacgggaaccggtaaacggggtacccggtaacgggtttacccgaacccgttaacgttaccccgtaacccgtaacggtaacggtaacgttacggtaaaccgtttacgaaacggtaaaccggaaaccgtaaccgggtaccgttaacgttacgtaacgaacgtaaagtaacgaaaccgtacgtaaccgtaaacggaaacgaacggaccgaccggtacggtacgttacgttacgtacggtacgacgacgtactacgttaccgtacgttaacgttacgtttagttttaccgtggttcgtacccgg

SEQ ID NO: 59424 - DNA, 851 bp, Homo sapiens
  misc_feature: GYAE6OF01AU4RZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctggtggaggtccgggggagcgttggtccgacgggcccggggggtccctagaaacctctcatgtcgcgaggctcgtggattcactattcagtcgacgtcggacttatagtaccgtcggggtcccgaccgtacggtcgtacgggacccgggggtaaaagggtccgtaggggaggttcgggtcgtttcggggtacccgttaaagtttaaccggaaaaccccgtaaaaccgttacggaaaccgtaaaacgggttaacccggaaccgttaaacgttaaacgtttttacgtacggtaccgttcgggtcccgggtttacgggttacggaaccgtaacgggtccgtaacgggtttaccaacccgtacgttacccgtaccgaaggtaacggtaacgttagtaacgtttacgaagggtaaaccggtaaacccggaccgggtaccggttaacttccggtaacgaacgtaaaggtacgaaaaccgaccggtaacccgtaaacgggtaaaaacccgggacgggtaacccgacccgggttaccggttacgtttaaaccgttacgtacggtaccggtacccaacggtaccgtaccgtttacccgttacggtttaaacgtttaacggttttacgtttttaccggagggtttcccggtaacccggg

SEQ ID NO: 59425 - DNA, 682 bp, Homo sapiens
  misc_feature: GYAE6OF01DTP9J.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggagtccgggggagcttggtccaggccggggggtccctgaaacctctcagtgtgcgaggctcgtggattcactattcagtgactcggctatactacgtcgggtccgccagtcgtcggacccggggaaaggcgtgggaggtcggtcgttggaccgttaagttaacgaacccaaacgtgaacgaacggttaacgaccgtaactaaagtttagcgtacgtcggcggttcggtgaccgaagggccgtacggtaccacctattcctaccgaagagtaatgtacttacgaagacgaacgtacggtacgtatacgtagtacaaacgtacgaaacgtacgtaccgtaacggaaaacccggaaggtacccgaaccgggttaccgtaagttacgttacgtacggtacgtaccgacgtaccgaaccgttcccgttaaccgttaacttttaaccggtttatttttaccgacggtttccggttaacccgg

SEQ ID NO: 59426 - DNA, 623 bp, Homo sapiens
  misc_feature: GYAE6OF01EEI8V.26.57.F02.1.454.CMB.1.raw
  modified_base (425)..(425): a, c, t, g, unknown or other
  misc_feature (425)..(425): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttggtccgaggcccgggggggtcctgaaactctcatgtgcgaggctcgtggattcactattcagtgactcggctatatacgtcgggtccgccagttcgtggaccggggaaagggcgtgggaggtggcgtttcgggaccgttaagttaacgaacccaaaccgtggaacaagtacgacgaactaatttatcgtctcggcgttcggngacgaaacgggtcgtacggttccacctatcctaccgagagaatgacttacagaagaacgacggtcgtatctagaacaaagtacgaacgacgaccgtaacgaaaccggacggacgacggaccggttagtacgttactggtacgacaacgacgtacgttccgtacgttactttacgtttatttttcgtcgttcgtacccg

SEQ ID NO: 59427 - DNA, 609 bp, Homo sapiens
  misc_feature: GYAE6OF01EEY1Y.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttggtccgaggcccgggggggtccctgaaactctcatgtgcaggctctggattcacattcagtgactcggctatatacgtcgggtccgccagtcgtggccggggaaggcgtgggagtggcgttgggccgttagttaacgaaccaacctgaaccaagtacgcgactaatttatgctggcggtcggtagacgaaggcgtacggttaccaccactctaccagagatagacttacgaagaacgaacgacggacgtactcgtacgacgaaatacgaacagaccgtaacggaaaccgacggaccgacggtaccgtagtacttacgtacgtcgtaccgacgtacgacgtccgttacgttaactttacgttactttttacgtaggttcggtacccg

SEQ ID NO: 59428 - DNA, 728 bp, Homo sapiens
  misc_feature: GYAE6OF01CJRN7.26.57.F02.1.454.CMB.1.raw
  modified_base (272)..(272): a, c, t, g, unknown or other
  misc_feature (272)..(272): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttccttgttgacttaattttaaaaggtgtccagtgtctaggtgcagcgtggtggaggtccgggggagtcgttggccgagggtcccggggggtcctagaaacgtctcgagttgngcgaggtctcgtggtattaccactattacgagtcgacgtcggactatagtacgtcggtccgacacggtctcgggaaccgggaaaggtccgtaggtacggtcggtcgttcggtaccgttaagttaacggaaaccctaaacgtaggaaacgtaacggtaacgacgtaactaaagtttacgtgtcgtacgtccgggtaggtacgacgaaagggtcgaacggttaccaacctaaccgtcgtaacccgaagtacgtaagtagtaacgttacgaacgggtaaacgtaaaccggtaacggtaccgttaacgtttacaagtaaaccgtaaagtaaccgaaacgtaacgtaaccgtaaaccggaaacgggtaacgaacggtaccgtacggtacgtacgtacgtcgtcgacacgtactacgtaccgttacgtacgtttacttacgttttcacggttcgttaaccgg

SEQ ID NO: 59429 - DNA, 718 bp, Homo sapiens
  misc_feature: GYAE6OF01BCBBD.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcctgttgctatttaaaaggtgtccagtgtcaggtgcagctggtggagtccgggggagcgttggtccgaggccgggggtcctgaaactctcatgtgcgagctctggattcactattcagtgactgctatactacgtcgggtcccgacgtagtcgtacggaccgggaaagggtccgtgggacgtcgggtcgttcgggtaccgttaacgttaacgaaaccccgtaaaccgtagaaacgtaaacggtaaccggtaaccgtaaccgtaaagttttaacgacggtccggttacggtccgggttacggtacgtaccgaacgggtcgtaagggtttacccaacgtacggtcctaaccgaaggtagtacgtaggtaacttcgaaaggaacgaaccgacggtctactcgtaagacgaaacgtcggaaaccacggtaccgtaaaggaaacccggacggtacccaacgggtccgtacggttacgttaacgtcggtaaccaccgtaacgtacccgagttcccccgtaagtttaccgttaacgtttaccttttccgaggttacccgttaccggg

SEQ ID NO: 59430 - DNA, 652 bp, Homo sapiens
  misc_feature: GYAE6OF01ARGTX.26.57.F02.1.454.CMB.1.raw
  modified_base (386)..(386): a, c, t, g, unknown or other
  misc_feature (386)..(386): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttggtccgaggccgggggggtccctgaaacctctcatgtgcaggctctggattcactattcagtgactcggctatatactgggtccgccagtctggaccggggaaggctgggagtggcttgggctattagaaccaacgtgaacaagtacgcgaactaatttancgtctagcggtcggtgcgaaggtcgtacgttccaccatcctacgagtacgataggtattcgaaggaagaaccgacggaccgtactacgtagactaaagtacgaaacgacgtaccgtaacggaaaacccgaacggaccgtaaccggtaccggttagttaaccgttacgtacggttccggaccaacggaccctacgttaccccggttaacggtttaacgtttaaccgtttaagttttttaccgtaacgggtttccggttaaccccggg

SEQ ID NO: 59431 - DNA, 821 bp, Homo sapiens
  misc_feature: GYAE6OF01DER6U.26.57.F02.1.454.CMB.1.raw
  modified_base (328)..(328): a, c, t, g, unknown or other
  misc_feature (328)..(328): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttaattttaaaaggtgtccagtgtcaggtgcagctgggtgggagggtccgggggaggtcgttgggtccgacgggcccgggggggtccctaggaaaccttcctcagtggtgcaggctcgtggattcacattcaagtgactcggctatatacgtcgggtccncctagtcgtggaccggggaaagggcgtggagtcgggtcgttgggccgttaagttaacgaaacccaaaccgttgaaacgaaacggttaaccggaccgtaaccgtaaaattttaagtacggtacgttcggtccgggttcgggtttacggaccgtaaacggggtcccggtaaacgggtttacccaaccccgtaacgttaccccgttaccccggaaacgggtaaaggttaacgtaacggttaaaccgtttaaccgaaagggtaaaacccgtaaaaccggtaacccgggtaccggtttaaacgttacgtaacgtaaccgtaaaaagttacggaaacccgaaacccggtaacccgtaaacgggtaaaaacccggaacgggacccggaacgggttacccgttaggttaaaccgttacgtacggtacggaccaacggtaacgtacgttacccgttacgttaacgtttacgtttactttttacgtaggttccggttaacccg

SEQ ID NO: 59432 - DNA, 782 bp, Homo sapiens
  misc_feature: GYAE6OF01EP4MM.26.57.F02.1.454.CMB.1.raw
  modified_base (199)..(199): a, c, t, g, unknown or other
  misc_feature (199)..(199): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggagtttgggctgagcttgggttttccttgttgcttaattttaaaaggtgtccagtgtcaggtncagctgggtggaggtccgggggaggcgttggtccgagggcccgggggggtccctgaaactctcatgtgcgaggctcgtggtattcatattcagtgactcggactatatacgtcgggtccgccagtcgtgggaccggggaaaggggcgtagggacgttgggtccgtttcgggacccgtttaagttaacggaaaacccaaaccgtagaaaccgtaaacgtacggacgtaaactaaagttttacgtgtcgttacgggccggttcgggtcgaccgaaagggtccgtaacggttacccacctactacccgtaccgaaggtaagtagttagtaacgttacgaagtaaacgaaaccggtaaccgggtacgttaacgttccgtaggaacctaaaagtaccggaaaccgtaacgtaaacccgtaaacggtaaaaacccggaacgggtaaccgaacccgggtaccggttaggttaaacctttaacgttacggtaccgtaaccggtaacgtaaccgtaaccgttacccgtttaccggttaacgttttaaccggttttacgttttttaacggttccgggttcccggttaacccgg

SEQ ID NO: 59433 - DNA, 780 bp, Homo sapiens
  misc_feature: GYAE6OF01DQL75.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctgggtggaggtccgggggaggcgttcgggtccgagggcccgggggggtccctggaaaccgtctcagtgtggcgagggcctcgtaggattacacgtattcagttcgactcggctatagtacgtcgggtaccgccgaggttccgtacggtacccggggaagggtccgtgggaaggttgggccgttcgggaccgttaagttaacgaaacccgtaaaccgtacgaaccgaaacgtacggaccgtaaacgttaaatttagtcgtacgtcgggtcggttacgggtagaccggtaaagggtccgtacggttacccaaccgtactaccgtacccgaagtaacggacgttaggtaagttaccgaaacggtaacggaaaccgacgggtaaccgtactacgtacgaacaaacgtaacggaaaccgaccggtaaacccgtaaacgggtaaaacccggtaacgggaacccggtaaccgggtacccggttagttaaacgttacgtaaccggttacggaccaaccggtaccgtacgttacccggtaccgtttaacgtttaacgtttagtttttaccgtagggttcccgttacccgg

SEQ ID NO: 59434 - DNA, 659 bp, Homo sapiens
  misc_feature: GYAE6OF01CPR3A.26.57.F02.1.454.CMB.1.raw
  modified_base (412)..(412): a, c, t, g, unknown or other
  misc_feature (412)..(412): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctgaaactctcatgtgcaggctcgtggacttcactattcagttcgactcggactaatactacgtcgggtccgccgtagtcgtcggacccgggaaagggccgtgggaggtcggcgttggtaccgtagtaacgaacctaaaccgtgaacgtaagtacgacgaactaatttaacngtctgtacgtcggtacgacgaacggcgtaggttccaccgtatccgtacaggacgagtacgtacttacgaagaacgaacgacgtacgtagtctagaacaaagtacgaaacgacgtaccgtaacggaaaacccgggacggaccggaccggtaccgttagtaaacttacgtacggtccgaccgaacgtacctacgttcccgttacgttacgtttaaccgtttagtttttaccgaggttccggttaacccg

SEQ ID NO: 59435 - DNA, 622 bp, Homo sapiens
  misc_feature: GYAE6OF01AFH3A.26.57.F02.1.454.CMB.1.raw
  modified_base (392)..(392): a, c, t, g, unknown or other
  misc_feature (392)..(392): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttgggtccaggcccgggggggtccctggaaactctcatgtgcaggctcgtggattcgacattcagtgactcggctatatactgggtccgcagtctggacccgggaagggctggagtggcgttggcgttattacgaacccaaaccgtgaacgaagtacgcgaactaagtttancggtctggccgttcgggtgaccgaagggaccgtaggtttaccaaccctattaccgtaccgaaggagacttaggacttacgaggaagaaccgacggtacgtactacgtagacaaatcggaaacacgtaccaacgaaaccggacggaaccgacggaccgttagtaccttacgtgtccgtacagtcacgttaccgttacgttacttacgttatttttccgagttcggtacccg

SEQ ID NO: 59436 - DNA, 804 bp, Homo sapiens
  misc_feature: GYAE6OF01EDOWF.26.57.F02.1.454.CMB.1.raw
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgcttaagttttaaaaggtgtccagtgtcgaggtgcagcgtgggtaagggagggtccggggggaggcgttcgggtccgacgggtcccggggggtcctaggaaactctcgagtgtgcgaggctcgtggattcactattcagtgactcggctatntacgtggtccncagtcgtacggccgggaaaggctgggagttcggcgttcgggaccgttaagttaacgaaaacccgaaaccgttggaaaccgtaaagggtaccgaacggtaaacttaaacgttttaagtcggtacgttacgggcccggtttacggggttacgacggtaaacgggtaccggttaacgggttacccaaacccgttaacgttacccgtttaaccccgaaaggtaacgtaacgttacggtaaacgtttacgaaaggtaaacgaaacccgtaacgggtaccgttaacgttaccggtagtaaccgtaaaacgttacgaaaccgtaccggtaacccgttaaacggaaaaccgaacgggaaccgtaaccgggtaccggttacgttaaacgtttacgacggttaccgaccgtaaccgtaccgtaacgttacccgttaacgtttactttacgtttaccgttttttacgacggttcggttaacccg

SEQ ID NO: 59437 - DNA, 791 bp, Homo sapiens
  misc_feature: GYAE6OF01DUKAC.26.57.F02.1.454.CMB.1.raw
  modified_base (651)..(651): a, c, t, g, unknown or other
  misc_feature (651)..(651): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggagtttgggctgagtcttgggttttccttgttgtacttaattttaaaaggtgtccagtgtcaggtgcagcgtgggtggacggtccgggggaggtcgttcggtccggacgggcccgggggggttacccctaggtaaaaccttcgtaccgtaagttcggtcggacgtacgggtccgttccggttaggtaacgttttacccaacgttacgtttacgtaacggttcggtaccgttaccgggtacctttaagttaaccgttaccgggttccggggtaccccgtcccgtaacggttccgtaccgggacccggggtaaacgggtccgtagggtacggtgggtaccgtttcggtacccgttaagttaaaccgaaaccctaaccgtaggaaaccgtaaacggtaccgtaacgtaaaccttaagtttaacgtcgtacgtggtaccggtcggtagacgaacggcgtaacggttccaactaccgtactaccgagacgtagacgtagtagaacgaacgacgtacggnttactagtacgacgtaaagacgaacgaacgtaccgtaaacgaaaccggtacgaccgtacggtaccgttagtcgttacgcgtacgacgaagtaccttcggtaccgtagttactttacgttagttttctaggtcgttaaccg

SEQ ID NO: 59438 - DNA, 703 bp, Homo sapiens
  misc_feature: GYAE6OF01ASNP8.26.57.F02.1.454.CMB.1.raw
  modified_base (428)..(428): a, c, t, g, unknown or other
  misc_feature (428)..(428): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgcttaagttttaaaaggtgtccagtgtcaggtgcagcgtggtggaggtccgggggaggcgttggtccgagggcccgggggtcctagaaactctcgagtgtcgcgacggtctcgtggtattccaactacttcgagtcgactcggtactagtactacgtcgggtccgcgtagtccgtacggaccgggaagggctgggagtggcgtcggtcgttaagtacgaaaccaaccgtgaacgaacgtacggacgtaacttaagtttncgtacgtcggcggtacggtcgacggtacgtaccgtacgttaccaaccgtacgtccgtacgtaagtacgtaacgtacgtaacttacgaacgtaacggaaaccgtacggtacgttaacgttcgacgtaaacgtaagtaaccgaacgaacggtaaccgaaaccggaaaccggaccgaacggtccggtacgttaggttacctacgtacggtacgaccgaagtccgttacgtaccgttacgttacgtttacgtttacttttcggacgtttccggtaccgg

SEQ ID NO: 59439 - DNA, 845 bp, Homo sapiens
  misc_feature: GYAE6OF01EW38F.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtaggctatttaaagtgtcagtgtcaggtgcagctgggtggacggtccgggggagtcgttggtccgaggcccggggggtcctggaaacctctcgatgtgcgacggctcctggtacttccaatactttcaggtgtactcggtactatacgttaccgtgggtccccgcacggttcgtcgggaccggggtaaaggggccgttagggacgttgggtccgtttagggaccgttaattaacgggaaacccctaaacgtacggtaaaccaaacggtacggtacccgtaaaagtaactttaagtcggacgttcgggccgggttaccggggtacgtaaccggaacgggttaccgttaacgggttcccgtaacctacgtttacccgtacccggaaaggtaacgttagtacggttaaaccgttacgaacgggtaaaccgaaccggtaacgggtacctttaacgggtaccttacgaacgaaacgttaaccggaaacctaccgggtaaccgtaaacccgggaaaaccgggtacggaaacccgtcccgggtaacggtttaaccttaaaggttacccgttaagggtccgtaaccccggtaaagtaccccgttaacgggttacccttttaaaccggtttaaacggttttaccggttttaaacttttttaaccgggttcggtaaacccgggtttaccccgg

SEQ ID NO: 59440 - DNA, 662 bp, Homo sapiens
  misc_feature: GYAE6OF01EGAPX.26.57.F02.1.454.CMB.1.raw
  modified_base (400)..(400): a, c, t, g, unknown or other
  misc_feature (400)..(400): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggaggtcgttggtccgaggcccgggggggtccctgaaactctcatgtgcgaggctcgtggattcacattcagtgactcggactatatactgggtcccgcaggtcgtggaccggggaaaggctgggagtggcttggacctatacgaaccaactgacaagtacacgtacaatttatgctgcgtcggtnacgagtctaggttccaccatcctaccgtagacgtagtagtacgttacgaacggtaacgaaccgaaccggtcgtaacttacggtactaacgtaaacgtacgaaaccgaacgtacccggttaacggaaaacccggtacgggaacccggtaccggaccggtttacgtaacgtttacggtacggttcgaccaacggtacccgtaacgttccccgttaacgtttaacgtttaccgtttaatttttaccgtaggttccggttaacccg

SEQ ID NO: 59441 - DNA, 864 bp, Homo sapiens
  misc_feature: GYAE6OF01D3HID.26.57.F02.1.454.CMB.1.raw
  modified_base (267)..(267): a, c, t, g, unknown or other
  misc_feature (267)..(267): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagcgtggtttctgttgctaatttaaaggtgtcagtgtcaggtgcagcgtggtggaggtccgggggaggtcgttggtccgagggcccgggggggtcccctaggaaacctctctagtgtgcnggctcgtaggtacttacgactattacgagtcgaccgtcgactatactacgttcgggccgacgtagtcgtacggaccgggggaaggcgtagggagtcgggtaccgttcgggtaccgttaacgttaacgaaaccccgtaaaaaccgtcgaaacggtaaacggtacccgaacgaacgttaaaagttttacgcggtaccggtacggtcccggttaggggtacgaaccggaaacgggtaccgtaacggtttacccaaaccttacgtaccctaccggtaaaggaagtaacgttacgtaacgttacgaaacggtaaacggaaaccggtaccgggacgttaaacgttccgaacggtaaccgtaaaacgttaccggggaaactaacccgggttaaccgtaaaaacggggtaaaaacccgaaccggggtaaacccgggtaaccgggttaacccgtttaacggttaaaccggtttaacccggtccggtaacggaaccccggtaaagttaaaccccggtaaccggtttccccgggtttaaacgtttacggttttaaaaccccgttttaggttttttaaccggtaacccgggtttccggttaaaccccgg

SEQ ID NO: 59442 - DNA, 795 bp, Homo sapiens
  misc_feature: GYAE6OF01BK2FQ.26.57.F02.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggtcgtttcgtcgtaaggcgtacttaaagtgtcagtgtcaggtncagcgtgtgagtccgggaggcttggccgaggtccgggggtcctagaactctacgatcganccgaggtctcgtaggtcttacaccgtaactttcgaacgttaggaccttccggacttaagttacgtaacgtacggggttcccaccgtaagttcggtaacggtacccggggaaagggaccgtacgggtacggtaggtcggttacccgggtaacgggtttaactttaaccgggaaaacccctttaaaccgaggttaaaccgtaaagggtacccgggaaccgttaaacgttaaaccgttttaacgaccgtacggtaccgggtacggttaacggtaccgtaaaccggtaacggtccggttaaccgttacctaaccgtacgtaccgtaccgtaagtaacgtacgttacgtaactacgaaacggacgtaacggtacggtaccgtacgtacgtaacgaacgtaaacgtacgaaccgtaccgaaccgtaaaccggaaaccggacgtacccggtacgtacggttaacgtacctcggtacgtacccgtacgacgtaccgttacgttaccgttaccgtttacttacgtttagtttaccgtaggtccgtaacg

SEQ ID NO: 59443 - DNA, 801 bp, Homo sapiens
  misc_feature: GYAE6OF01C34X2.26.57.F02.1.454.CMB.1.raw
  modified_base (507)..(507): a, c, t, g, unknown or other
  misc_feature (507)..(507): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttccttgttgcttaagtttttaaaaggtgtccagttgtcaggtgcagcgtgggtggacggtccgggggagcgttggtccgacgggtcccggggggttccctaggaaaccttcgtcagttcgtggaccgtaggggtccttcggtacggtactttcgaactacgtttaccgaaggttcggtaaccgtcggtacttaacgttacgttaccggtcggggttaccccgccgtaggttccgtacgggaccggggaaagggtcgtagggtacggttcggtacgttcgggaccttaagttaaccgaaaaccgtaaccgttacggaactaaacggtacgacgtaacttaaatttcgngtacgtgtacggtcggtacgacgaagggtctacggttaccaactacgtcgtacgaagagtagtacgtattacgaaggtaacgaacggtaaccggtacttacgtacgttaacgaacgtaaacgtacgaaaccgtacggaaccgtaaaacggaaaccggaccgtaacggacccggtaacggttacgttaaccgttaggtaccggacgtaaccgtaacgtacggttacccgttaccgggttaacgtttaacgtttaaccggttttatttttacccggtacggttccggttaacccgg

SEQ ID NO: 59444 - DNA, 843 bp, Homo sapiens
  misc_feature: GYAE6OF01BI2SM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgtgctattttaaaaggtgtccagtgtcaggtgcagctggtggagtccgggggagcgttggtccaggccggggggtccctgaaacctctcatgtgcaggctcgtggattcactattcagtgactcggctatatacgtgggtccgaccgagtcgtcggaccggggaaaggccgtgggacgtgggtcgttgggtaccgttaattaacggaaaccctaaaccgtacggaaactaaacggtacccgacggtaacttaaagttttaacgtcgaccgttggtaccgggttacgggttaccgaacggtaacgggtaccgtaacgggtttaccctaaacccgtaacgtttcccctaacccgtaaagggaacggtaacgttaacggtaacgtttaccgaaagggaaacggtaaaaccgtacccggggtacgtttaaacgttaccgttaacggaaacccgtaaaagttaaccgggaaaacccgtaaccggtaaaccccggttaaaaccgggaaaaaccccgggaacgggtaaaccccggtaaccgggtaaccccggtttaacggttaaacgtttaaccgttccgggtaaccggtacccgtaaccggaacgttacccgttcccgggttaaacgttttaacgtttaacccgttttaacggttttttaccgaagggtttcccggttaaacccgg

SEQ ID NO: 59445 - DNA, 539 bp, Homo sapiens
  misc_feature: GYAE6OF01BED62.26.57.F02.1.454.CMB.1.raw
  modified_base (306)..(306): a, c, t, g, unknown or other
  misc_feature (306)..(306): n is a, c, g, or t
  modified_base (375)..(375): a, c, t, g, unknown or other
  misc_feature (375)..(375): n is a, c, g, or t
  modified_base (528)..(528): a, c, t, g, unknown or other
  misc_feature (528)..(528): n is a, c, g, or t
tcagagactatactcacgaccggtgctcgatttagctcgatatagttgggtttggggctgggagaggagctccagccttgggattcccagctgtctccacacggtgatcggcactgaatacaagagactcaccatggagtttgggctgagctgggttttccttgttgctattttaaaaggtgtccagtgtcaggtgcagctggtggagtccgggggaggcttggtccgaggccgggggggtccctgaaactctcatgtgcaggctctggattcacattcagtgactcggctatatactggggtccnccagtctgccgggaaggctggagtggcttggccgtatagaaccaactgacaagtacgcgaacaatttangctgcgtcggtgcaaggcgtacggttcaccatctcagagatgattcagagaacacggcgtatctagcaaatcgaacacgacctagaaaccgaggacacggcgtgtactacgtgtcgcagctacgtccgttacgttacttacgttatttttcgnggtcgtacccg

SEQ ID NO: 59446 - DNA, 716 bp, Homo sapiens
  misc_feature: GYAE6OF01DZ517.26.57.F02.1.454.CMB.1.raw
  modified_base (290)..(290): a, c, t, g, unknown or other
  misc_feature (290)..(290): n is a, c, g, or t
  modified_base (405)..(405): a, c, t, g, unknown or other
  misc_feature (405)..(405): n is a, c, g, or t
tcagagactatactcacgaccggtgctcgatttagctcgatatagttgggtttggggctgggagaggagctccagccttgggattcccagctgtctccactcggtgatcggcaatgaatacaagagactcaccatggagtttgggctgagctgggttttcctgttgctattttaaaaggtgtccagtgtcaggtgcagctggtggagtccgggggagcttggtccaggccggggggtcctgaaactctcatgtgcaggctcgtggtattcacattcagtgactcggctanattacgtcgggtccgcctagtccgtggccggggaaagggcctgggaggttggcgtttgggcccgttattaaaggaacccaaaaccgtgaacaagttaaccgacgtaacaaatttntagcttggcgttacgggtagccgaaaggccgtaacggggttacacctacgtacttacccaaggaacgaattagtaacttacgaagaacggtaaaccgaacggtaccgtaagtacgtacgaacgtaaacgttaagaaaccgtaagtacccgtaacgggaaaaacccgaacggaaccgtaacgggacccggttagttaaaccgttacggtaacggttaccggtaccgaacggtaacgtaacccgtaccggttacgttaaaccgttttaacgttaagttttttttacccggttaaggttaccggtttaacccgg

SEQ ID NO: 59447 - DNA, 642 bp, Homo sapiens
  misc_feature: GYAE6OF01C5UXF.26.57.F02.1.454.CMB.1.raw
  modified_base (408)..(408): a, c, t, g, unknown or other
  misc_feature (408)..(408): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagctggtttccttgttgctatttaaagtgtccagtgtcaggtgcagctggtggaggtccgggggagcgttggtccgaggccggggggtccctagaaactctcatgtgcaggctcgtggattcactattcgagtgactcggactatagtacgtgggtccgccagtcgtcggaccgggaaagggcgtgggagtggtcgttggccgttaagttaacgaacccgtaaaccgtgaactaacggtaccgacgtaactaaagtttacncgtacgtcggtcggtcggtagacgaaggtcgtacggtaccaccgtatcctacagagtatagtacttacgaaggaacgtaaccgacggtacgttacgtacgtagaacaaagtacgaaacgaacgccgtaacggaaaaccgaacgggaccgaacgggtcccgtagtacttacgtggtcgaccgagaccgttacgtcccgtagttacttaacgtttattttacgcgttcggtacccg

SEQ ID NO: 59448 - DNA, 724 bp, Homo sapiens
  misc_feature: GYAE6OF01A4RFK.26.57.F02.1.454.CMB.1.raw
  modified_base (191)..(191): a, c, t, g, unknown or other
  misc_feature (191)..(191): n is a, c, g, or t
  modified_base (300)..(300): a, c, t, g, unknown or other
  misc_feature (300)..(300): n is a, c, g, or t
  modified_base (335)..(335): a, c, t, g, unknown or other
  misc_feature (335)..(335): n is a, c, g, or t
  modified_base (564)..(564): a, c, t, g, unknown or other
  misc_feature (564)..(564): n is a, c, g, or t
tcagagactatactcacgaccggtgctcgatttagctcgatatagttgggtttggggtcgtggggagaggagctccagccttgggattcccagctgtctccactcggtgatcggcactgaatacaagagactcaccatggagtttgggctgagctggttttccttgttgcttattttaaaggtgtccagtntcaggtgcagctggtggacggtccgggggaggtcgttggtccgagggtcccgggggggtccctggaaacctctcgactggtgcgaggcctacgtggattccgatacttnagtgaacttcggactatacgtacgtcggggtaccncgagtccgtgggacccggggaaagggtcgtcgggaggtgggtacgttcggccgttaattacggaaccaaaccgtagaacgaacggttacgacgtaactaaagtttacgtgacccgttggtccgggtaccggtagaccgaaagggtctacggtttaccaccgtacttcctaccgaggaatagtacgtacttacgaacgacgaacgtaaccggacgttacctgtacgtaanaaactaggaacgacgtaccgtaacgtaaaacggcggtaaccacggtacggttagttacgttaataccgggtacgtaccaaggtaaccgtaccggttaccttaaccgggtttaacctttaaacgggttttatttttaaccggtcggttccggtttaacccg

SEQ ID NO: 59449 - DNA, 702 bp, Homo sapiens
  misc_feature: GYAE6OF01DDNJA.26.57.F02.1.454.CMB.1.raw
  modified_base (689)..(689): a, c, t, g, unknown or other
  misc_feature (689)..(689): n is a, c, g, or t
tcagagactatactcacgaccggtgctcgatttagctcgatatagttgggtttggggctgggagaggagctccagccttgggattcccagctgtctccactcggtgatgggcactgaatacaagagactcaccatggagtttgggctgagtcttggggttttccttgttgcttaattttaaaaggtgtccagtgtcaggtgcagcgtggtgggaggtccggggggagtcgttagggtcccgacgggtcccgggggggttcccctaggaaacctctactagtggtgcgaggtctacgtaggatttcacatttccaaggtcgaccgtcggctaatatacgttgggtcccgcgaggtctacgggaccgggtaaagggtcgtagggagtcgggtcgttcgggacccgttaagttaacgaaaccctaaaccgttcggaaacctaaaggtaccgacgtaaactaacgttttaagtgtacgtcggtcgtacggtagacgaagggtctacggttaccacctacgtcctaccgagagtagtacgtattacgagaaacgaacgtacggaccgttagaccgtagaacgtaaatacgaaaccgaagtaccgaaacgaaaccgacggaccggacggtccgttagtacgttacgtacggtcgacacgactacgttccgttacgtaactttacgttattttcgngtttcggtacccg

SEQ ID NO: 59450 - DNA, 657 bp, Homo sapiens
  misc_feature: GYAE6OF01DCVGE.26.57.F02.1.454.CMB.1.raw
  modified_base (401)..(401): a, c, t, g, unknown or other
  misc_feature (401)..(401): n is a, c, g, or t
tcagagactatactcacgaccggtgctcgatttagctcgatatagttgggtttggggctgggagaggagctccagccttgggattccccagctgtctccactcggtgatcggcactgaatacaagagactcaccatggagtttgggctgagctgggttttccttgttgcttaattttaaaaggtgtccagtgtcaggtgcagctggtgggaggtcccggggggaggcgttggtccgagggcccgggggggtcccctaggaaacctctcatgtgcaggctctggattcacattccagttgactcggctatatactgggtcccgccagtcgtggaccgggaaagggcgtggagtggtcttggtcgtatacgaaccaaactgacaagtacgcgaactaatttangtctggcgtcggtgacgaaggcgtacggttaccacctatcctaccgaagagtatagtacttacgaagtaacgaaaccgacggtacgtactcgtacgaacgaaataggaaaccgacgtacccgtaaacggaaaacccggaacgggtaccgaccgggtaccgttagtaaccgtttacgtcggtcgaccgacgacccgtaacgttcccggttacgttacgtttaaccgtttatttttacgacggttccggttaacccgg

SEQ ID NO: 59451 - DNA, 668 bp, Homo sapiens
  misc_feature: GYAE6OF01ENBSY.26.57.F02.1.454.CMB.1.raw
  modified_base (190)..(190): a, c, t, g, unknown or other
  misc_feature (190)..(190): n is a, c, g, or t
  modified_base (241)..(241): a, c, t, g, unknown or other
  misc_feature (241)..(241): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggtcgttcggtctaaggcgtactaaagtgcagtgcagtncagctggtgagtcggagcttgccgagccggggtcctagaatctacagtggngacgtcgcgtagtgtatactactactcgtagtacgtcgtcgtacgtacgtacgtacgtcggtcgtaccgtcgtcggtacggacgggacggtcgtaggtaggtcggtcgttacggtacgtaacgtaaccgtaaccgtaacgtacgaacgtaacgtacgacgtaacgtaacgttacgtacgtacgtacgtcggtcgtacggtacgtacgtacgtacgtacgtaccgtacgtactacgtacgtaacgtacgtacgtacgtacgtaagaacgtaacgtacgtacgtacgtacgtacgacgtaacgtaacgacgtacgtaccgaacgaacgaacggtacgtaccggtaccgtacgttacgtacgtacgtacgtacgacgtacgttacgttacgttacgttacgttaacgtttacgtttacgttcgtcgtacg

SEQ ID NO: 59452 - DNA, 717 bp, Homo sapiens
  misc_feature: GYAE6OF01DNPNL.26.57.F02.1.454.CMB.1.raw
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (190)..(191): a, c, t, g, unknown or other
  misc_feature (190)..(191): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (234)..(235): a, c, t, g, unknown or other
  misc_feature (234)..(235): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggtagttgggctgagcggtcggttcgtgtagactagttaagtgcngtgtngtgnngngnggtgngcggngntgcgcggcgggtctagactcantgngnnggtntcgtagntcacnttagagtcgtacgtgtataatcgtcgtcggtcccagtgtcggtacggaccgggtaggcggtggagttcggtcgtagtacgttagaacctaacgaccgaagaacgtagacaacgtaatagttacgtcgtcgttacggacgttaccgggatcgggtaagtaccgtacggtacctaactaccgtacgtacgaaagtacggtataaaccgggttaacgaacgtaacggtaacggtaacccgggtacgttaacgacgttaacgtaaccggtaaacgtaaacgaaccgtaaccgtaaacccgggaaacccgggaaacggtaaaacccgggttaacggtaaccgggtaaccggttaccgtacgttactaccggtaccgtacgtaacccggttaccttaacggttaccggttaacgtttaacggtttacgtttaaccggttttactttcccgggttaaggtcccggttaacggg

SEQ ID NO: 59453 - DNA, 605 bp, Homo sapiens
  misc_feature: GYAE6OF01AV7D9.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaagtgtcagtgtcaggtgcagctggtggagtccgggggagcttggtccaggccggggggtcctgaaactctcatgtgcaggctctggattcacattcagtgactcggctatatacgtgggtccgccagtcgtggaccgggaaagggctgggagtggcttgggaccgttattacgaaccctaacgtgaacaaggtacgacgaactaatttagcgtactggcgtggtgactaagggctacggttcacctactctacagagatgacttacgaagaacgaacgacgggacgtactccgtagaacgaaagtacgaacgacgtaccgtaacgaaaccggaacggaccgaacggtccgtagtacttacgtggtacgaccacggactacgtacccgtacgttaacgtttaacgttatttttacgcggttcggtacccg

SEQ ID NO: 59454 - DNA, 658 bp, Homo sapiens
  misc_feature: GYAE6OF01CEQR0.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtgggaggtccggggggaggtcgttgggtccgacgggcccgggggggtccctagaaacctctcatgtgcaggctcgtggattcacattcagtgactcggctatatacgtgggtcccgcctagtcgtcggaccggggaaagggcgtagggaggtggtcgttcggacgttaattaaccgaacctaaaccgtgaacgaagtacggacgtactaatttagtgcgtcgacgtcggagacgaaggcgtacgttccacctactccgtacagagtatagtatacgaggaacgaaccgacggtacgtacgtactagtacaaagtacgaacacgacccgtaagaaaccgacggaccgacggtccgtagttaccgttacgtcgtacgaccgtaacgtccgtacgttacccgttacgttaacgttttaacgtttacgtttttaccggtaggtttccggtacccgg

SEQ ID NO: 59455 - DNA, 908 bp, Homo sapiens
  misc_feature: GYAE6OF01APKX1.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggaggcgttggtccgagggccggggggtcctaggaactcgtcatgtgcaggctcgtggattcactattccgtagtgtaccgtcggctaagttactaccggtcggggtcccgaccgtaggtccgtacgggacccggggaaagggtccgtaggggaacggttcgggtcgtttacgggacccgtttaacgttaacgaaaaccccgtaaaccgtacggtaaaccgtaaacggtaccggaccgtaactttaaactttagtacggtcgttacggtaccgggttacgggttacgaccggtaaacgggtccgtaaacgggtttacccgaaccccgttaacgttacccgtaacccggaaagtaacggttaaccgttaaggtaacgtttaaccggaaaggaaaccggtaaacccggtaacgggttacctttaacggtaaaccgttacggtaaaactaaagttaaccggtaaaacccgtaaccgggtaaaccccggtaaacgggaaaacccggggttaaacgggtaaaccggtaacccgggttaaacccgttagggtttaaccgtttaaccggtacgggttaacccggtaacccggtacgtaaacccggttacgttacccccgggttttaacgttaaacccggtttttaaacgggtttaaccttttttaccggggtaacccgtttaacccgggtttaaccccggg

SEQ ID NO: 59456 - DNA, 637 bp, Homo sapiens
  misc_feature: GYAE6OF01D0J4D.26.57.F02.1.454.CMB.1.raw
  modified_base (489)..(489): a, c, t, g, unknown or other
  misc_feature (489)..(489): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttgggtccgaggccgggggggtccctgaaactcctcatgtgcgaggctcgtggattcacattcagtgactcggctatatacgtcgggtaccgccagtcgtggaccggggaaagggcgtggagtggcttggccgtaagtacgaaaccaaacctagaactaaaggtacgacgaactaaactttagtcgctggcggtcggtagacgtaaaggtccgaggttaccaccactcctaccgaagagatagattacgagtaacgaacgtacggngtaactcgtagaacaaagtacgaacgacgaccgtaacggaaaaccggacggaccgaccggtacgtacggttacttacgtcgtcgaccgacgtaccacgttaccggtaacgttacttaacgttatttttccgtaggttcgttaccccgg

SEQ ID NO: 59457 - DNA, 554 bp, Homo sapiens
  misc_feature: GYAE6OF01EC05N.26.57.F02.1.454.CMB.1.raw
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggaggcttggtccaggccggggggtcctgaaactctcatgtgcaggctctggattcacattcagtgactcggctatatactgggtccnccagtctggccgggaagggctgggagtggcttggccgtattagaaccaaacctgacaagtacgcgacaatttangctgcgttcggtgacaaggcaggttcaccagtctccagagatgattacgagaagaacacggtcgtagtctagacaaagtacgaacacgaccgtaagaaaccgacgacgacggaccgtagtattacgtgtcgaccagacacgtccgtacgtattacgttatttttcgagttcggtacccg

SEQ ID NO: 59458 - DNA, 811 bp, Homo sapiens
  misc_feature: GYAE6OF01DCBMQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgcttaattttaaaaggtgtccagtgtcgaggtgcagcgtgggtgggacggtccgggggagtcgttcggtccgacggggtcccggggggtaccctagaaacctctcagtgtgcgaggtctacgtggtacttcactattccagtcgactcggcttaatactacggtcgggtcccgactaggttccgtacgggaccggggtaaaggtcgtagggtaggtcggtcgttacgggaccgttaaagtaaccggaaaaacccgtaaacgtcgtaaaacgtaaacggtaaccgacggtaaactttaaaatttcgtaaggtccgttaggtccgggtacgggtacgaaacgtagggtaccgtaacgggtttacccaaccgtacgtaccgtaccggaagtaacgtaacgtagtaacttacggaaacgtaaacggtaaccgaacgggtacgttaacgtccgtaaacgaactaaacgtaacaaacccggtaacggtaaacccgtaaaacgggaaacccggtacgggtaaccggtacccgggtaaccgttagtaaaccgttcgtaggtaaccgacgtaacggtacccgttacgttacccggtttaacgttaacttttaacgtttacctttttaacggcggtttaccggttaacccggg

SEQ ID NO: 59459 - DNA, 804 bp, Homo sapiens
  misc_feature: GYAE6OF01DR9O5.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttccttgttgtcttaagttttaaaaggtgtccagtgtcgaggtgcagctgggtggaggtccgggggagtcgttgggtccgagggtccggggggtcctaggaaactctcagtgtgcgaggtctcgtggattcgactattcagtcgtacgtcggtactagtacgtacggtcgggtcccgccgagttccgtacgggaacccggggtaaaggtccggtagggtacggttcggtaccggttacgggtacccgttaagttaaaccggaaaacccgttaaaccgtcggaaacgtaaacggttacccggaacgtaaacgttaaacgtttacgtacggtcgtcggtaccggttacgggtacgtacggtaaacgggtccgtacggttacccgtaaccctacgtacccgtaccgaaggtaacgtaacgttaggtaaccgtttacgaacggtaaacggtaaccgtacgggtaccgtaccgttacgtacgaacgtaaacgtacgtaaccgacgtaacccggtaacggaaaccggtaccggaaccggtaccggtacggttaacgttaccgttaacgtcggtaccgtacgaacggtacctaccggttacccgttacgtttacgtttacgttacgtttttcgacggttccggttaacccgg

SEQ ID NO: 59460 - DNA, 767 bp, Homo sapiens
  misc_feature: GYAE6OF01BQPFM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtctgggttttccttgttgtctaattttaaaaggtgtccagtgtcgaggtgcagcgtggtggacggtccgggggagcgttcgggtccgacgggccggggggtccctgaaacctctcagtgtgcgaggctcgtggtacttacactatttcgaaggtcgtacgtcggtctagttacgtacgtcgggtccgtccgtagtcgtacgggaccggggaaacgggtcgtagggagtcgggtacgttcggtaccgttaacgttaaacgaaacctaaaccgttagaaaccgtaaacggtaaccgaccggtaaacttaagttttaacgtcgtacgttcggccggttacggtcggaacgaacgggtccgtaacgggttacccgtaacctaactccgtaccgaacggtaagtacgtaacgtagttacggaacgtaacggaaaccgtacggtacgtaacgtcgtacgaacgtaaagtacggaaaccgacgtaaccgtaaacggaaaccggtaacggaccggtaccggtacgtacgttaacgttacggtaccgtacgtaccgaacgtaccgtacgttacccggtacgtttaacgttaaccgttttagttttacgtaccggttcggtaacccg

SEQ ID NO: 59461 - DNA, 611 bp, Homo sapiens
  misc_feature: GYAE6OF01CIIFC.26.57.F02.1.454.CMB.1.raw
  modified_base (401)..(401): a, c, t, g, unknown or other
  misc_feature (401)..(401): n is a, c, g, or t
  modified_base (554)..(554): a, c, t, g, unknown or other
  misc_feature (554)..(554): n is a, c, g, or t
  modified_base (599)..(599): a, c, t, g, unknown or other
  misc_feature (599)..(599): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggttttccttgttgctattttaaaaggtgtccagtgtcaggtgcgagctggtgggaggtccggggggaggcgttggtccgacgggcccgggggggtcccgtgaaactctcaaaatgtgcgaggctctggtacttcacattcagtgactcggctatatacgtcgggtccgccgagtctggaccgggaaagggcgtggagtggtcgttggcgtatacgaaccaaacctcgacaagtacgacgactattangctgcgtcggtgacgaagcgtagtacctaccactccaccagagatagacttcgaagtaacgaacgaccggacgtatcgagtactaaagtacgaacacggtactaacggaaaacgggacggaaccgaccggccgttagtaccttagtcggtacncacgtacctacgttacccgttagtaactttacgtttattttacgnggttcggtaccg

SEQ ID NO: 59462 - DNA, 799 bp, Homo sapiens
  misc_feature: GYAE6OF01AIFKB.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgtctatttttaaaaggtgtccagtgtcaggtgcagctgggtgggaggtccgggggaggcttgggtccgagggcccgggggggttccctaggaaaccttctcatggtgcgaggtccttcgtggatttcactattcgagtgacctcggctatataccgtggggtcccgccgagtcgtacggacccggggaaagggtcgtgggaggtcgggtcgttagggtccgttaagttaacggaaaccctaaaccgtaggaaacgaaacggtaccgaccggtaacctaaagttttagcgtcgttcgccgggttcggtagccgaagggccgtaggttaccaaccgtactaccgtcccgtaaggaacgtagttacggtaacttacgaaacggaacggaaacccgtacgggtaccgttaacgtcgtaacgaacgtaaacgtaacggtaaacgaaccggtaaccgtaaaccggaaaacccggaacgggaacccgtaacccgggtaccgttaggttaaaccgtttaacggtacggttaccggacccgtaacggtaacccgtaaccggtttacccggttaacccggtttaaccgtttttacggtttaaactttttttaccgggtacggtttcccgggtttaaccccggg

SEQ ID NO: 59463 - DNA, 708 bp, Homo sapiens
  misc_feature: GYAE6OF01EN7C5.26.57.F02.1.454.CMB.1.raw
  modified_base (322)..(322): a, c, t, g, unknown or other
  misc_feature (322)..(322): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgtctaattttaaaaggtgtccagtgtcaggtgcagctgggtggaggtccgggggagcgttggtccgagggccggggggtcctgaaacctctcagtgtgcgaggctcgtggtacttcactattcagtcgactcggtactatagtacgtcggggtccnccgtaggtcgtacggaccggggaaagggtcgtagggacggtggtccgttgggaccgttaattaacgaaaccctaaacgtcgaaaccgtaaacggtaccgacgtaactaaagtttacgcgtcgtacggtaccggttcggtacgaaccggtaagggtaccgtaacggttaccaaccctacgttaccgtaccgagaagtagtagtacttacgaagaacgaaccgtacggtctaacgtcgtagaacaagtacgaacacgtaaccgtaacggaaaccgacggaaccgaccggtacgtacgttacgttacgtacgtccgtacgacgtaccgtacgttacccgttacgtttacgtttaacgtttagttttacggtacggttccggttacccgg

SEQ ID NO: 59464 - DNA, 759 bp, Homo sapiens
  misc_feature: GYAE6OF01AHNCB.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttttaaaaggtgtccagtgtcaggtgcagctgggtgggaggtccgggggaggtcgttggtccgagggcccgggggggtccctagaactctcatgtgcaggctcgtggattcacattcagtgactcggtactatagtacgtcgggtccgcctagtcgtcggaccggggaaagggcctgggacgttcgggcgttacgggaccgttaagtttacgaaacccgtaaacctgaacctaaacggtacgaccgtaactaaatttagtacgtcgtcgtcggttcggtcgacgaacgggcgtaacgggttaccaaccctacgtaccctaccgaagacgtaattacggtaacgttacgaaggaacggaaaccgtaccgggtaacgttacgtaccgttacgaaccgtaaaagtaccggaaacaccggtaacccggttaaacggaaaaaccccggacgggaacccgtaaccgggaccggtttaggttaactttaccggtcggtaccggaccgtaacgtacccgttaacgttcccggtttacgtttaaacggtttacgttttaaccgttttttaccgaagggtttttcccggttaacccgg

SEQ ID NO: 59465 - DNA, 765 bp, Homo sapiens
  misc_feature: GYAE6OF01BN55B.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctattttaaaaggtgtccagtgtcaggtgcagctgggtgggaggtccgggggaggcgttggtccgagggcccgggggggtccctaggaaacctcgtcagtgtgcagggctacgtggtacttcaccgtattccaggttcgactcggcttaattacgtacgtcggggtcccacctaggttccgtacgggaccggggaaacgggtcgtgggagtgggccgttacgggccgttaattaacggaaaccctaaacgtcggaaacgtaacggtacgtacgtaaacttaatttagtcgtacgtcggtaccggttagggtacggtacggaaagggtccgtaacgggttaccaacccgtacgtaccgtacccgtaagaacgtaagtacgtaacgttacgaaggtaaacggaaccgtaacgggtccgttaacgtacgtacggaaagtaaacgtaacgaaaccgtaacggtacccgtaaacggaaacccggaacgggaaccgtacccgggtacgttacgtaaccgtttacgtacggttcgaccgtacggtaactaccgttaccgttaccgttagtttacgtttacgttttacgacggttccggtaaccg

SEQ ID NO: 59466 - DNA, 902 bp, Homo sapiens
  misc_feature: GYAE6OF01B2EG6.26.57.F02.1.454.CMB.1.raw
tcagagactatactcacgaccggtgctcgatttagctcgatatagttgggtttggggctggggagaggagctccagccttgggattcccagctgtctccactcggtgatcggcactgaatacaagagactcaccatggagtttgggctgagtcgttgggtttccttgttgtacttaagttttaaaaggtgtccgtagttcgtcgaagggtgcaggtctgggtggacggtccgggggaggtcgttgggtccgacgggtcccggggggtccctaggaaaccttcgtacctagtggttacggccgtaggtccgttcggttacgggtactttaccgtaacggtaactttccggtaaacgttcggtaccgttaccgggtactttaacgttaccgttacggtccggggttcccgaccgtacggttcgtacgggtacccggggaaagggtccgtaggggtacggtggtccttagggtacccgtaagtttaaccgaacccgtaaaccgtggaaccgtaagtacccggacgtaacttaacgtttagcgttcgtacggtacggttacggtacgtacggaaacggtcgttaacgggttcccaaccgtacgttacccgtacggtaaacgtacggtacgttaacgtaacgttaccgtaaagggaaccgttaaaccgggtccgtaccgggtttataccggtttaacgaacgtaaaccgttacgaaaccggtaaccgtaccggtaaaaccgggtaaacccgtaggtaaacccccggtagggtaacccgttacgggtttaaacgttcccgttacgggtaaccgtaccctaaacgggttcccgtaaaccgttaccgggtttaaaccgttacgttttaacccggtttaacgttttcccgtaacgggtccgttaaccccgg

SEQ ID NO: 59467 - DNA, 662 bp, Homo sapiens
  misc_feature: GYAE6OF01C3RP5.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggttttcctgttgctatttaaagtgtccagtgtcaggtgcagctggtggaggtccgggggaggcgttggtccgaggccggggggtccctgaaacctctcatgtgcgaggctcgtggattcacattcagtgactcggctatagtacgttgggtccgccagttcgtcgggacccggggaaagggcgtgggacgtgggtcgttgggcccgttaagttaacggaaaccctaaaccgtgaaccgaagtacgacgaactaatttatagctggcgttcggtgacgaaggcgtaggtcaccatctaccgagagactagtactacgagaagaaccgacggacgtactacgtagacgtaaacgtcgtaacgacgtaccgtaaccggaaaaccggtacggacgaaccgggtaccgtacgttacgttaaccgttggtaccgaccgaacggtaccgtaacgttcccggttacgtttaacgttttacctttaaggttttttccgtaggtttcccggtaacccgg

SEQ ID NO: 59468 - DNA, 789 bp, Homo sapiens
  misc_feature: GYAE6OF01BRHN6.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgcttattttaaaggtgtccagtgtcgaggtgcgagcgtggtggaggtccgggggagcgttggtccgagggtccggggggtccctaggaaacttctctagtggtgaccgaggtctcgtggtacttcactattcgagtcgacctcggtctatacgtacgtcgggtcccgcgtaggtcgtacggaccggggaaaggtccggtggacggtcgggtacgttaccgggtccgttaagttaacggaaacccttaaaccgtaggtaaccgtaaagggtaccgaccggtaactaaacgttttagtccgtacgttacggtccgggttaccggttaggaccgtaacgggtccgtaaccgggttacctacccgtaacgttacccgtaccgtaaggaaggtacgtagttacttaaccggaagtaccggaaacgtaccgggtacgtaacgtccgtaagacgtaaaggtaacgaaccgtacgtaaccgtaaccggaaaaccggaccggaccgtaacccgggacgttacggttaacttaaccggtacggtacgaccgtaaaccggtcgttacccgttaccggtttaacggtttaacgtttaccgttttaccgttttacgtaccgggttccgttaacccgg

SEQ ID NO: 59469 - DNA, 612 bp, Homo sapiens
  misc_feature: GYAE6OF01AH2R6.26.57.F02.1.454.CMB.1.raw
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtcctgaactctcatgtgcaggctctggattcacattcagtgactcggctatatactgggtccgccagtctggccgggaagggctggagtggcttggccgtattacgaaccaaacctgaacaagtacgcgaactaatttatgctggcggttcggtgacgaaggcgtaggttcaccactctccagacgatgtattcagaagacgacggcgtatctagaacaaagtacgaacgacgtaccgtaacggaaaaccggacggaccgaaccgggtaccgttagttaacgtttaccgtaggtcgacccgaaggtacctacgttacccggttacgttaacgtttacgtttaactttttttcgaggtttccggttaacccgg

SEQ ID NO: 59470 - DNA, 962 bp, Homo sapiens
  misc_feature: GYAE6OF01BCBMQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggaggtccggggggaggcgttggtccgagggccgggggggtccctgaaacgtctcagtgtcgcgaggctcgtggattcatattcagtgactcggctatatacgtcgggtccgccgaggtctacggaccggggaaagggtcgtgggacggttggcgtttgggaccgttaattaacgaaacccgaaaccttacggaaacgtaacggtaacgaccggtaaactaaacgttttaacgtcgtaccgtcgggtaccgggttaccgggtttacggaccggtaaacggggtcccgtaacggggtttacccctaacccgtaaccgtttacccttacccggtaaaccggtaaacggttaaacgtttaacggggttaacgttttaaaccggtaaaccgggaaaacggggtaaaacccggtaacccggggttaacggtttaaacccgttccggtttaaaccgggaaacggttaaaaacgtttaaaccgggaaaacccggtaaaccgggtaacccgttaaaaccggggtaaaaaccccgggtaacccgggggtaaacccgtaaacccggggggttacccccggtttaaacgggtttaacgtttaaacccgggtttacggttaacccgggtaacccgttaaacccgggtaaccgttaaaccccggttttaaacccgggttaaccccggtttttaaaacggtttttaacccgggtttttaaccgttttttttaacgggttaacccggttttccggggtttaaaccccccgg

SEQ ID NO: 59471 - DNA, 894 bp, Homo sapiens
  misc_feature: GYAE6OF01DBOID.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgtcttaagttttaaaaggtgtccagtgtcaggtgcagcgtgggtgggaggtccgggggagcgttggtccgacgggtccggggggtcctaggaaactctcgatgtgcgacggctcgtggtacttcaactactttcaagttggaccgttacggtacctaagttacgttaccgttccgggggttcccgaccgtaacggttccgtacgggaaacccgggggtaaaggggccggttaggggaacgggttcggggttccgtttcgggtacccggtttaaagttaaaccggaaaacccgtaaaaccgttacggaaaccgaaaacggttacccggaaccggtaaaacttaaagttttaacgtacggtcccgttagggtcccggttacggggtacgtaaaccgtaacggggtccgttaacggggttacccgtaaccgtaccgttacccctaccgtaaggaacgttaacgtacgtaatttaccgaaacggtaaccggaaaaccggtacggttaaccgttacgttaccgtaacgaacgtaaacgtaacgaaacccgaccggttaaaccggaaaccggaaaaccgggtaacccgggaaccggtaaccgggttcccgttaaggttaaccgttttaaccgtaggtacccggtaaccgtaaacggtaccctaccgttaaccggtttaccgttaacgtttacgtttaaccggtttttacgtaaccgggttccggtaacccg

SEQ ID NO: 59472 - DNA, 755 bp, Homo sapiens
  misc_feature: GYAE6OF01D40J1.26.57.F02.1.454.CMB.1.raw
  modified_base (602)..(602): a, c, t, g, unknown or other
  misc_feature (602)..(602): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagtcgttgggttttccttgttgcttaattttaaaaggtgtccagtgtcaggtgcagcgtgggtgggaggtccgggggaggtcgttgggtcccgacggggtcccggggggtccctaggtaaacctctacgatggtgcgtaggctcgtaggtacttacacgtattccgaggttacgtacgtccggtacttagtacgtaccggtcgggtcccgccgtaggtccgtacgggacccggggtaaagggtcgtgggtaggtcggtcgttcgggtaccgttaacgtaaccgaaaccctaaccgtacgaacgtaacgtaccgtacgtaacttaagtttacgtcgtcgtacggcggtacggtacgaccggaagggtacctaacggttaccaacctacgtccctaacgtaagtacgtagtagtaacgtacgaaggtaacgaaccgtacggtacgtactcgtaanaacaagtaccgaacgaccggtaacctaaacggaaaccgtacgtaccggtacggtaaccgttagttacgttacgtcgaacgtaccgtaacgtaccgtacgttacccgttacgtttacgttacgttttaactttccgaacggttccggtaaaccg

SEQ ID NO: 59473 - DNA, 831 bp, Homo sapiens
  misc_feature: GYAE6OF01A9N6G.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagtctgggttttcctgttgcttaattttaaaaggtgtccagtgtcgaggtgcagcgtgggtagggaggttccggggggagtcgtttcgggtcccgacggggtcccgggggggtacccttaggaaaaccttccgtcgaagttgtcggacgagggtccttcgtggtaactttccaacgttacttcgtaaggttcgaacgttccgggtacttaagttagtaccggtacggggtcccctaccgtacggtttccgacgggaacccggggtaaaggggtccgtaggggtaagggtcgggttacgtttcgggacccggtttaaagtaaccggaaaccctaaccggtaagaaccgtaaacgttacggaccgtaaactaagtttacgtacgtacggttcgggtaccggttaccggtaaggaaccgtaacggggtaacgtaccggttaccgaaccgtaccgttcctaaccgaagacgtaacgtagtaacgttacggaacgtaaacggaaccgacgggtaccgtaagtacgtacgaactaaacgtacgtaaccgaacgtaacccggtaaaccgaaacgggacggaccggaccggtacttacggtacttacggtcgtacgtaccgacgttaacgtacttaccggttaacgtttacgtttaacgtttacgttttccgtaggttccggttaacccg

SEQ ID NO: 59474 - DNA, 596 bp, Homo sapiens
  misc_feature: GYAE6OF01CD3ED.26.57.F02.1.454.CMB.1.raw
  modified_base (396)..(396): a, c, t, g, unknown or other
  misc_feature (396)..(396): n is a, c, g, or t
  modified_base (585)..(585): a, c, t, g, unknown or other
  misc_feature (585)..(585): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccggggggtccctgaaactctcatgtgcaggctctggattcactattcagtgactcggctatatactgggtccgccagtcgtcggaccgggaaagggcgtggagtggcgttgggccgtagttaacgaacctaaaccgtgaacgaaagtacgacgaactaatttangctgcgtcggtgcaaggcacggtcaccatctaccgagagatgattacgaggaacgaacgtacgggacgtacgtactacgactaaagtacgaaacacgaccgtaacggaaaccgacggaccgacggtaccgttagtacgttacgtgtacgaccgacgactacgtccgtacgttacttacgttattttcgngttcggtaccg

SEQ ID NO: 59475 - DNA, 744 bp, Homo sapiens
  misc_feature: GYAE6OF01B35TS.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccgggggagcgttggtccgacgggtccgggggggtccctagaaacctctccgagtggtggacagggcttcgtaggtacttcaactatttcgagttcgtacctcggtacttaagtactacggttcggggtccccgaccgtaggttccgtacgggacccggggtaagggtccgtagggagttcgggtccgtttacggggaccgttaaagttaaccggaaaaccctaaaaccgtggaaaccgtaaacggttaccggaacgtaactaaagttttacgcgtacgtcggcggttacggtgaacgtaacgggcgtacggttcaccgtactacctaccgaagtaagtacttagtaacttacgaaggtaacggaaccggtaacggtacgttaactacgtagaacgtaagtaacgaacacggtaacgtaaaccggaaaccggacggaaccggaccggtaccgttagttacgtaacgtcgtacgacctagacctacgttaccgttacgttacgtttacgtttattttcgtacgttcgtacccg

SEQ ID NO: 59476 - DNA, 817 bp, Homo sapiens
  misc_feature: GYAE6OF01AD67B.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccgggggaggcgttggtccgacgggcccgggggggtccctaggaaactctcatgtgcaggctcgtggattcactattcgagtgactcggactatatacgtcggggtcccgccagtcgtggaccggggaaagggcgtgggaggtcgggtcgttcgggaccgttagttaacgaaacccgtaaaccgtagaaccgtaaacgtaccggaccggaaacttaaacttttaactcggtcgttcgggccggtttccgggtacggaccggtaaagggtccggtaacgggtttaccctaacccgtaccgttacccgtaccccgaaggtaacgtacgttacggtaactttaccgaaagggaaaccggtaaacccggaaccgggttaccgttaacgttaccgtacggaacgtaaacgtaacggaaaccgtacggtaacccggttaaacggaaaacccgggaacgggaacccggtaccgggtaccggttacgtttaaacgttaccggtaggttacccggtaccgtaacggtaccgttaaccggtttacccggtttaacgtttaacgttttaaccggttttacgttttttaccgtaacggtttcccgggttaaccccgg

SEQ ID NO: 59477 - DNA, 830 bp, Homo sapiens
  misc_feature: GYAE6OF01AS9QM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagctgggttttcctgttgcttattttaaaaggtgtccagtgtcaggtgcagcgtgggtggagggtccgggggagtcgttgggtccgagggtcccgggggggtccctagaaaccttctcgagttggtgcgaggctcgtaggtacttaccactacgttcgaagttggacccgttacgggtacttaagttacgttaacggttcgggggtacccgtcccggtaacggttccggtaccgggaaccggggggtaaaagggtccggttaggggtacggttacggggttccgtttacggggacccggtttaaaggtttaaaaccgaaaaccccgtaaaaccggttacggaaaccgtaaaacgggtaccgaaaccgtaacttaaacgtttacgtcggacgttacgggtccggttcgggtaggaaccgtaaacggggtccgttacggttacccaaccgtactcccgtaactaaggtaacgtaactggtaactagaacggaacgaacgaccgggtacttaacgtcgtacgaacaacgtaacgaacgacgtaaccgtaacggaaacccggtacggaaccggtaccgggtacgttagttaccttaaccggtcgtacggaccctacggtacgttaaccgttccggtttaacgttaacgtttacgtttaaccgttttcgtaccggttcgttaacccgg

SEQ ID NO: 59478 - DNA, 677 bp, Homo sapiens
  misc_feature: GYAE6OF01DLRF0.26.57.F02.1.454.CMB.1.raw
  modified_base (402)..(402): a, c, t, g, unknown or other
  misc_feature (402)..(402): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgcttatttaaaaggtgtccagtgtcaggtgcagctggtggaggtccgggggaggcttggtccaggcccggggggtcctgaaactctcatgtgcaggctctggacttcacattcagtgactcggctatatacgtgggtcccgccaggtcgtcggccggggaaagggcgtgggaggtggcgttgggacccgttaattacggaacccaaacctgaactaaagtacgacgactaaatttangtactggcgttggacgcaagggtctacggtaccaccgactctacagagaatgtacttacgaaggaacgaaccgacggtacgtaagttctacggacaaagtacgaaacctacgtaccgtaacggaaaaccggaacggaccggaacgggtacccggttacggttaacgtttaaccgttcggtaacggtacccgaacgtaaccctaacgttcccggtttaaccgtttaacgttttaaccggtttatttttttaccggtaacgttccgggttaaccccg

SEQ ID NO: 59479 - DNA, 698 bp, Homo sapiens
  misc_feature: GYAE6OF01BUBKN.26.57.F02.1.454.CMB.1.raw
  modified_base (423)..(423): a, c, t, g, unknown or other
  misc_feature (423)..(423): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagcgtggtggaggtccgggggagtcgttggtccgagggcccggggggtccctggaaacctctcagtgtgcgaggctcgtggacttcactattcgagtcgacgtcggactatactacgtcgggtcccgcctagtcgtcggaccggggaaaggcgtagggagtggtcgttggaccgtaattaacgaaccctaaaccgtcgaacaacgtacgacgtaactaatttagngtcgtgtcggtcggtgacgaacggtcgtacggttccacctagtcctacgagagtacgtagtacttacgaacgaacgaaccgacggtacgtactacgtacgaacgtaagtagaaccgacgtaaccgtaaacggaaacccggtaacggaaccggtaccggtaccggttaacgttaacgttaacggtcggtacgtaccgtaacggtacctaaccgttaccggttacgtttaacggtttaccgttttaagtttttccgtaacggttccggttaacccgg

SEQ ID NO: 59480 - DNA, 612 bp, Homo sapiens
  misc_feature: GYAE6OF01D0QXP.26.57.F02.1.454.CMB.1.raw
  modified_base (292)..(292): a, c, t, g, unknown or other
  misc_feature (292)..(292): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctgggtggaggtccggggggaggcttggtccagggcccgggggggtccctaggaacctctcagtgtgcaggctcgtggattcgactattcagtnactcggactatatacgtgggtccgccagtctgggccggggaaaggctggagtggcttggccgtatacgaacaacctgaacaagtacgnacaatttgngctggcgtcggtagacgaaggctaggttccacctatcctaccgagacgtatgtattcgaacgagaacgtacggacgtactctagactaaatacgaacacggactaacggaaaccgagaccgacggtccgtagttagttaccgtggtaccgaccgaagcctaacgttcccggtaagtttaaccgtttaacgtttagttttttaccgacggttccggttacccgg

SEQ ID NO: 59481 - DNA, 852 bp, Homo sapiens
  misc_feature: GYAE6OF01D639V.26.57.F02.1.454.CMB.1.raw
  modified_base (370)..(370): a, c, t, g, unknown or other
  misc_feature (370)..(370): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagcttgggttttccttgttgcttaatttaaaaggtgtccagtgtcaggtgcagcgtgggtgggagggtcccgggggaggtcgtttcggggtcccgacggggtccccggggggggttccctacgggtaaaaccttccgttccgagtggtcggccgtaggtccttcgtaggtacttacacgtattccgagttgaccgtcggacttatagtacgtcgggtcccnccgtagtccgtacgggaccggggtaaacgggcgtagggtacggttcgggtaccgtttcgggtacccgtttaagttaaccggaaaaccctaaaccgtacggaaactaaacggtacgaacgtaaacgtaaactttagtcgtacgtacgggccggttacgggtcgaaccggtaacgggtaccgttaacgggttaccacccgtattccgaccggtaagacgtaagtacgtacgttacgaaggtaaaccgaacggtaccggtacgttacgtccgttaacgaacgaaagtacgtaaaccgaaccgggtacccgtaaaaccggaaaccgggtaaccggtaaccggtaacccgggtaccggttaacgttaaccgtttaccgttaacccgggtccgtaacccgtaaccggtaacccgttaccgttacccgtttacggtttaacttttaaccggtttacgttttttaccgtacggtttcccgggttaaccgg

SEQ ID NO: 59482 - DNA, 750 bp, Homo sapiens
  misc_feature: GYAE6OF01DCBZF.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagcttgggttttccttgttgcttattttaaaggtgtccagtgtcaggtgcagctgggtggacggtccggggggaggtcgttgggtccgacgggcccggggggggtccctagaaacctctctatggtgcaggtcctcgtggacttacactacttcgagtgactcggctatactacgtcgggtccgcctagtcgtcggaccgggaaaggggccgttagggaggtcgggtcgttacgggtaccgttaagttaaccgaaaccgtaaaccgtcgtaaaccgtaaacggtaaccggacgtaaacttaaactttaacgtggtacccgtggtcccgggttcggtacgtacgaacgggtcgtacggttaccaacctactacgtaccgaagtagtagttacgtaacgttacgaaggtaacgtaaaccgacgggtaacgttaacgtacgttacggaaactaaacgtacgtaaacgacgtaccgaaacgggtaaaaccggacgtaaccgaccgggtaccgttacgtacgtttacgtacggtccgtaaccaggtaacctacggttaccgttacgttactttaacggtttacttttacggcggttccgttacccg

SEQ ID NO: 59483 - DNA, 1039 bp, Homo sapiens
  misc_feature: GYAE6OF01DIGDY.26.57.F02.1.454.CMB.1.raw
  modified_base (539)..(539): a, c, t, g, unknown or other
  misc_feature (539)..(539): n is a, c, g, or t
tcagagactatactcacgaccggtgctcgatttagctcgatatagttgggtttggggctgggagaggagctccagccttgggattcccagctttctccactcggtgatcggcactgaatacaagagactcaccatgggagtttgggctgagtcgttgggtttttccttgttgcttaagttttaaaaggtgtccagtgtcaggtgcagcgtgggtgggaggtccgggggaggtcgttggtccgacgggcccgggggggtcctaggtaaactctcgagtggtgcgaggctcgtggacttcactattcaaggtgtaccgtcggtacttaagtacgtacggttcggggtcccgaccgtaacggttccgttacgggacccgggggtaaaaaggggtcccggttaaggggtacggttcgggggtcccgttttacggggtaccccggtttaaacggtttaaaccgggaaaaacccctaaaaccgtttacgggaaaacccgtaaacgggttaaccggtaacggtaaaacccttaaaagtttttaacncgggtaccgttcgggggtaccggtttaccggggtggtaaaccggaaacgggggtaccgttaaaccggggttacccgtaaaccccgtaacgtttccccgttaaccccggaaggggttaaacgaaccggttttaaggaaccgttttaaccgaaaacggggtaacccgggtaaaaacccggtaacccggggttaaccgttaacgttacccgggttaaccgggtaaccttaaaaaacgggttaaccgaaaacccgggtaaacggtaacccccggttaaaaacgggaaaaaacccccgggtaacgggtaaacccgggtaaccccgggttaaccgggttaaacggggtttaaccttaaacccgggtttaggtaaccccgggtaaccgtaaaccgtaaccggttacccggtttaacccggttaaccggtttttaaaaccgtttacccggtttttaacgttttttacccgggtaacgggtttcccgggtcccgtttaaaacccggggg

SEQ ID NO: 59484 - DNA, 869 bp, Homo sapiens
  misc_feature: GYAE6OF01DCNXQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagctgggttttccttgttgctattttaaaaggtgtccagtgtcaggtgcagctggtgggaggtccgggggaggtcgttggtccgagggccgggggggtccctggaaacctctcatgtgcgaggctctggacttcactattcagtcgacgtcggcttatactacgtcggggtccccgaccagttccgtcggacccgggggaaaagggtccgtgggtacggtcggggtaccgttcggggtcccgttaaagttaaccggaaaaccctaaaccgttacggaaaccgtaaacggttaaccggaccgtaaaacgttaaaacgttttagtacggtactttcggggtaccggtttaccgggttacgggaaccgtaaaccgggggtaccgttaacccggggtttaccctaaccccgtaaccgttaccccgttaccgtaaacggtaacgttaaggtaacgtacgtttaacgaacggtaaacggtaaaaccggtaccgggtaccggttaacgttccgtacgaacgtaaacgttaacgaaaccgaacgtacccggtaaccggaaaacccgggaacgggaacccggtaaccgggtacccggttacggttaaactttaccggtacggttaccggaccctaacggtaacccgtaaccgtttacccggttaaccggtttaacgttttaacccggtttaccgttttttaccggtacggtttaccggggttaccccgg

SEQ ID NO: 59485 - DNA, 599 bp, Homo sapiens
  misc_feature: GYAE6OF01BXI4T.26.57.F02.1.454.CMB.1.raw
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (537)..(537): a, c, t, g, unknown or other
  misc_feature (537)..(537): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctggtgggaggtccgggggaggtcgttggtcccgacgggcccgggggggttccctaggaaacctctcagtgtgcgaggtctcgtggattccaactattcagtcgactcggactatactacgtcgggtccgcctagtcgtggaccggggaagggcgtggagtggcgttggccgtaattacgaaccaactgaacaagtacgcatattatgntgcgtggncgagcagtcacatctcaganatagntacgagagaacgacgtcatcgagacaagtagaacacgtacctaaggaaacccggaggaccgaccgggaccgttagttacttacgtggtccganacggtaccacgttccggttacgttacgtttaacgtttagtttttccgtggtccggttacccg

SEQ ID NO: 59486 - DNA, 807 bp, Homo sapiens
  misc_feature: GYAE6OF01C722A.26.57.F02.1.454.CMB.1.raw
  modified_base (286)..(286): a, c, t, g, unknown or other
  misc_feature (286)..(286): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggagtttgggctgagtcgttcgggttttccttgttgcttaagttttaaaaggtgtccagtgtcgaggtgcagcgtgggtgggaggtccgggggagtcgttggtccgacggggcccggggggtccctaggtaactcctcgatggtgaccgnggtcctcgtaggtacttcgtaactattaccgtagttacggtaccgtacggtacttaacgttacgttaaccggttcccggggttacccgaccgtaacggttccggtaccgggaacccgggggaaagggtccggtaggggtaacggtcgggttaccggtttacgggtaccgttaaagttaaacccggaaaacctaaaccggttacgtaaaccgtaaacggtaccggtacgttaaaaccgttaaagtttaacgtcggtacgttcgggtaccgggtttacggtcgaacggtaacggtcgttaaccggtacaccgtacgtacgtaccgaggtaatacgtagtacgttaacaacggtaacgaaccgtaccggtagttacacggtacaaacgtaaagtacggaaccgtaccggtaaccgaaaccggaaacgacggtaaccgtccggttacgttagtaccttaggccgtacgcgaacgtcgtaccgttacgttacgttaactttacgttaatttcggagtccggttacg

SEQ ID NO: 59487 - DNA, 865 bp, Homo sapiens
  misc_feature: GYAE6OF01BDVLZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagcttgggtttttccttgttgtcttaatttttaaaaggtgtccagtgtcaggtgcagcgtgggtggaggtccgggggaggtcgttgggtccgacggggcccgggggggtccctaggaaacctctcagtgtggcaggctcgtggtattcacatttcagtcgacgtcggctattacgtacgtcggggtcccgccacgtcgtcgggaccggggaaacgggtcgtgggaggtgggtccgttcggggtacccgttaagtttaaccgaaaacccgtaaaccgtaggaaaccgtaaacgggttaccgaaccgtaaaccttaaagttttaacgtcggtacgtcgggttccgggttacggggtgaaccggaacgggtccggtaacgggtttcccaacccgtacttaccgtaacccggaaggtaagtaacggttacgttaaacgtttaccgaacgggaaacggtaaacccggtaaccggggtaaccgttacgttaccgtacgtaaccgtaaaacgtaccggtaaaccgtaccgtaaacccggtaaaccgggtaaaaaccccgggaaggggaaccccggtaacccggggtaccggtttaacggtttaaccctttaacggtacggttcccggaacccgtaacggtaacccgttaccgttaccccggtttaagtttaaccgtttttaccgtttaacttttttacccggtaagggtttcccggttaacccgg

SEQ ID NO: 59488 - DNA, 856 bp, Homo sapiens
  misc_feature: GYAE6OF01EX6YN.26.57.F02.1.454.CMB.1.raw
tcagagactatactcacgaccggtgctcgatttagctcgatatagttgggttggggctgggagaggagctccagccttgggattcccagctgtctccactcggtgatcggcactgaatacaagagactcaccatggagtttgggctgagctgggttttcctgttgctattttaaaggtgtccagtgtcaggtgcagctggtggaggtccggggggagcgttcggtccgacggggcccggggggtccctaggtaaacctctactagtggtcgcgtacggtcttcgtggtacttccgaactacttctaggtcgaccgtcggacttaagtacgtaccgtcggggtcccgccgtaggtccgtacgggaccggggtaaacgggccgtggggtaggtcggtcggttacgggtaccgttaagtaacgtaaacccctaacgtacgaaaccgtaacggtaccgaccgaacttaagtttacgcgacgttacgggccggttacgggtacgaaccgtacgggtaccgttaagggttacccaacccgtactttacccggtaaccgtaaggtaaccgtagttcgttaaacgttacggaaacgggtaacggaaacccgtacggggtaacttacttaccggaacgtaaacgtaaacgttaccggaaaaccgtacccgggttaaccggtaaaaccggaaaaacccgggtcgggtaaaccccggtacccgggttacggttaaccggttttaaacttacccgggttaggtacccgaacccggaaacggtaccttacccggttaacccggttacgtttaaacgttttaccgtttttaaccgtttttacggaaccgggttcccgggttaaacccggg

SEQ ID NO: 59489 - DNA, 713 bp, Homo sapiens
  misc_feature: GYAE6OF01AE2OE.26.57.F02.1.454.CMB.1.raw
  modified_base (313)..(313): a, c, t, g, unknown or other
  misc_feature (313)..(313): n is a, c, g, or t
  modified_base (414)..(414): a, c, t, g, unknown or other
  misc_feature (414)..(414): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggagtcgttggtccgagggcccggggggtccctgaaactctcatgtgcaggctcgtggattcacattcagtgactcggctatagtacgtcgggtccnccgtagtcgtggaccggggaaagggcgtgggagtgggtcgttgggccgtaagttaacgaaacccaaaccgtgaacgaaacgtacgacgtaactaatttagngtacgtcggtccggtcggtgacggtaaagggccgtaacgggtttccaacccgtacgtacctacccgaagtaggtaactaggtaacttacgaaggaaacgtaaccgtaacgggtaccgttaacgtacgtacgaacgtaaacgtaacgaaccgacggtacccgtaaacgggaaaacccggacgggaacccgaccgggtaccgttacgttaacgttacgtacggtccgaccgaacgtccgtaaccgttccggttacgtttaacgtttacgtttactttttacgtacgggttcggttaacccg

SEQ ID NO: 59490 - DNA, 532 bp, Homo sapiens
  misc_feature: GYAE6OF01BQ0TP.26.57.F02.1.454.CMB.1.raw
  modified_base (371)..(371): a, c, t, g, unknown or other
  misc_feature (371)..(371): n is a, c, g, or t
  modified_base (522)..(522): a, c, t, g, unknown or other
  misc_feature (522)..(522): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactggtccgccagtctgccgggaaggcgtggagtggcttggccgtattagaccaactgacaagtacgcgacaatttangctgcgtcgtgcaaggcagttcaccatctccagagatgagttacagtagaacgacggcgtatctgacaagtgaacagacctacgaaacgacggacgacggccgtagtattacgtgtcgacacgacactccgtcgtacttacgtatttttcngttcgtaccg

SEQ ID NO: 59491 - DNA, 635 bp, Homo sapiens
  misc_feature: GYAE6OF01B7SVE.26.57.F02.1.454.CMB.1.raw
  modified_base (308)..(308): a, c, t, g, unknown or other
  misc_feature (308)..(308): n is a, c, g, or t
  modified_base (412)..(412): a, c, t, g, unknown or other
  misc_feature (412)..(412): n is a, c, g, or t
  modified_base (522)..(522): a, c, t, g, unknown or other
  misc_feature (522)..(522): n is a, c, g, or t
  modified_base (623)..(623): a, c, t, g, unknown or other
  misc_feature (623)..(623): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccaggccggggggtccctgaaactctcatgtgcaggctcgtggattcacattcagtgacgtcggctatatacgtgggtccnccagtcgtcggaccgggaaaggacgtgggagtcggtcgttgggaccgttaagttaacggaaaccctaaaccgtgaaccaaaggtacgacgtaactaaatttagngtacctggccggttacggtgacgaacgggacgtacggttaccaaccgtactccgtaccaaggagtatagtattacgaagaacggaacgacggcgtatcgtagacaagtanaacgacgtaccgtaacgaaacggacggacgacggtacgtagtattacgtgtacgaccgagtaccgacgttcccgttacgttacttacgtttatttttacgnggttcgtacccg

SEQ ID NO: 59492 - DNA, 703 bp, Homo sapiens
  misc_feature: GYAE6OF01A97GK.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttggtccgacgggccggggggtccctaggaaacctcgtcagtgtgcgaggctcgtggtacttccaagtattccgagtgaccgtcggtacttaattacgttaccgtcggggtaccccgtccgtaacggtccgtacgggacccgggggtaaaagggtccgttagggaaggttcgggtcgttcgggtaccgttaagtaaccgaaaccctaaaccgtgaacgtaacgtacgacgactaagttagtcgctacggcgtcggagacgaaggcctacggttaccaacctactcgtaccgagtacgtagtacgtagttacgaagacggaaccgtacggtactacgtagtacgaactaaagtacgaacacggtaaccgtaacggaaaccgacggaacgtaaccggtccgttagtaaacttcggtcgacgacgacggtactacggtaccttacgttaactttacgtttacgtttcgacggttacggtcccg

SEQ ID NO: 59493 - DNA, 586 bp, Homo sapiens
  misc_feature: GYAE6OF01EOV95.26.57.F02.1.454.CMB.1.raw
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggagcgttggtccaggccggggggtccctgaaactctcatgtgcaggctctggatcacattcagtnactcgctatatactgggtccnccagtctggccggaaggctggngtggcttggcgtatacgaaccaacctgacaagtacacgactaatttangactgcgtcggtgacgaagggcgtacggttaccacctactcctaccgtagaagattaggtattacgagaacgaacgacgggtacgtactcgtagtacaagtacgaacacgtaccgtaacgaaaccggacggaacgacggtaccgtagttacttacgtcgtcgaccagtactacgtccgtacgttactttacgttattttcgtagttcggtaccg

SEQ ID NO: 59494 - DNA, 578 bp, Homo sapiens
  misc_feature: GYAE6OF01DXLBK.26.57.F02.1.454.CMB.1.raw
  modified_base (302)..(302): a, c, t, g, unknown or other
  misc_feature (302)..(302): n is a, c, g, or t
  modified_base (373)..(373): a, c, t, g, unknown or other
  misc_feature (373)..(373): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggagtccgggggagcttggtccaggccgggggggtccctgaactctcatgtgcaggctcgtggattcacattcagtgactcggctatatacgtgggtccncagtctggaccgggaaggctggagtggcttggcctatacgaaccaacctgacaagtacgacgataatttangctgcgtcggtgacgaaggcacggttcaccatctccagagatgattcagacgaacgacggacgtactctgacaaacgtagaacacgaccgtaacgaaaccgacggaccgaccggtaccgttacggtacttacgtcggtacgaccgacgacctacgtccggttacgttacttaaccgtttatttttaccgaggttccggttacccg

SEQ ID NO: 59495 - DNA, 595 bp, Homo sapiens
  misc_feature: GYAE6OF01EYYUB.26.57.F02.1.454.CMB.1.raw
  modified_base (306)..(306): a, c, t, g, unknown or other
  misc_feature (306)..(306): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
tcagagactatactcacgaccggtgctcgatttagctcgatatagttgggtttggggctgggagaggagcctccagccttgggattcccagctgtctccactcggtgatcggcactgaatacaagagactcaccatggagtttgggctgagctgggttttcctgttgctatttaaaggtgtccagtgtcaggtgcagctggtgggagtccgggggagcgttggtccgaggccggggggtccctggaaactctcatgtgcaggctctggattcacattcagtgactcggctatatacgtcgggtccnccgagtctcggccggggaaagggtcgtggacgttgtcgttggccgttattaacgaacctaactagacaacgtagacgataatttangtactgcgtcggtgacgagctagtcacatcncagacgtatgtactacgagtacgaacgacggtactacgtcagacaagtacgaacgacgtacgaacgtaaacggacgacgacggtaccgtagttactacgtacgtcgaccgacgaccgtacgtaccgttacgttaacttaacggtttattttaccgtaggtccggttaacccg

SEQ ID NO: 59496 - DNA, 767 bp, Homo sapiens
  misc_feature: GYAE6OF01C932A.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctaattttaaaaggtgtccagtgtcaggtgcagcgtggtggaggtccgggggagtcgttggtccgaggggcccggggggtccctaggaaacctcgtcgagtgtgcgaggcttcgtaggtactttacactattcgaaggttcgacgtcggacttatacgtacgtcggggtcccgaccgtacgtcgtcggaccgggggaaagggtccgtagggtaggtcgggtacgtttacgggtaccttaaagttaaccggaaaaccctaaaccgttaggaaacctaaacgggtaccgacgtaacttaaagttttcgacggtcgtggtacccgggttggacgtaacggaaggtaccgtacggttacccacctacttaccgcaagtaagtataggtattacgaagtaacgaaccgtacggtacttactacgtacgaactaaacggtacgaaccgaaccggtaccgtaaaccggaaaccgggacggtaaccgacgggttaccgtaagttaaccgttacgtaccggtacgaaccgacgtaccgttaccccggttacgtttaaccggtttactttaccggtttatttttacccggacggttcccggttaaccgg

SEQ ID NO: 59497 - DNA, 786 bp, Homo sapiens
  misc_feature: GYAE6OF01A4IS3.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttaagttttaaaaggtgtccagtgtcaggtgcagcgtggtggaggtccgggggagtcgttggtccgagggcccgggggggtccctaggaaaccgttctacgagttgtgcgacggtctcgtggtacttcactattcgagtcgtaccgtcggacttatacgtacgtcgggtcccgccgtacggtccggtcgggacccggggtaaaggggtccgtagggtagggtcgggtccgtttcggggtacccgttaacgttaaacgaaacccgtaaaccgtacgaacgtaaacgtaccggaacgtaacgttaaagtttacgtgtcgtggtaccgggttcggtacgaccgaaacgggtccgttaaccgggttaccaaccccgttagtcccgtacgaagtacgtaagtacgtaacgttacaacgggaaacgaaaccggtaccggtacgtaactcgtaacgaactaaagtacgaaacgaacgtaacccggtaacggaaaaccggacggaccgaaccgggtacgttagttaaccgttacgtacggtaccggacccgtaagaccttaccgttacccggttacgtttaacctttacggtttaactttttcggacggtttacccggtaacccgg

SEQ ID NO: 59498 - DNA, 783 bp, Homo sapiens
  misc_feature: GYAE6OF01DXADX.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagtcgttgggttttccttgttgtcttaattttaaaaggtgtccagtgtcgaggtgcagtcgtgggtgggaggtccgggggagtcgttggccgacggggtccgggggtccctagaaacctctcgagtggtcgcgtaggctcgtggtacttcacgtactttacgagttacgaacctcggtacttaagtaacgtacggtcgggtcccgacgtacggttccgtacgggaccggggaaacggtcgtaggggacgttggtccgttacgggtacccttaagttaaacccggtaaaaccaaaaccggttacgaaaccgtaaagtaacccggaacgtaaaccgtttaaagtttagtcgaccgttgggtaccggttcggttacgacggtaaaccggtcgtacggttaccaaccgtacgtaccctacgaaagacgtacgtagtaacttagaagaacgtaaccgtacggtaacgtacgtaagtacgaactaaaacgacgaaaccgaccgtaacgtaaaacggaaaccggtaacggaaccgtaccgggtacttacgttaacgttacgtccggtacgacctaacgtaccgtacggttacccttacgtttaaccgtttacggtttattttaccgtacggttccggtaaccg

SEQ ID NO: 59499 - DNA, 583 bp, Homo sapiens
  misc_feature: GYAE6OF01BGN4F.26.57.F02.1.454.CMB.1.raw
  modified_base (270)..(270): a, c, t, g, unknown or other
  misc_feature (270)..(270): n is a, c, g, or t
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaggtgtccagtgtcaggtgcagctggtggaggtccgggggagcttggtccaggccggggggtcctgaaactctcatgtgcaggctctggattcanattcagtcgactcggctatatacgtcgggtccgcaggtctcggaccggggaaaggctggagtggcttggccgtaatacgaaccaaacctgaacaagtacgcgaactaatttagngctggcgtggtgacgaaggcaggttccacctncctccagagatgattcaaggacgtaaacgcggtacgttatctagacaaatcgaaacgagaccgtaacggaaaaccgaggaccgtaccgggtacctggttactaacgttggacgaccagtaccacgttcccgttagtacttacggtttattttcaggttcggtacccg

SEQ ID NO: 59500 - DNA, 843 bp, Homo sapiens
  misc_feature: GYAE6OF01BRQCX.26.57.F02.1.454.CMB.1.raw
  modified_base (199)..(199): a, c, t, g, unknown or other
  misc_feature (199)..(199): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtncagctgggtggaggtccgggggaggcgttggtccgacgggcccgggggggtccctaggaaacctctacagtgtgcgaggctcgtggacttcactattcgagtgaccgtcggactagtataccgtggggtcccgcctaggtccgtcggaccggggaaagggtctgggacggtggtcgttcgggaccgttaattaacgaaacccaaacgtcggaaacaacggtacgacgtaacgtaaactttagtacgtctacggcggtttcgggtagaccgtaaagggtacccgtaacgggttacccaaccctaacgttccctaccggtaacggaaacgtagttaacggtaacctttacggaaacggtaaaccggtaaaacccggtaaccgggtacggtttaaacttccgtaacgtaaacgtaaaacgttaacgaaaacccggtaaccggtaaacccgtaaacgggaaaaaccccggaacgggaacccgtaacccggggtaaccggttaacggtttaaaccggttaaccgttacgggttccgtaaacccgaaaccggtaaccgtttaacccggttaccccggtttaaacgttttaaacgtttaaccggttttaacgttttttaaccggtaacgggtttcccggttaaaccccggg

SEQ ID NO: 59501 - DNA, 829 bp, Homo sapiens
  misc_feature: GYAE6OF01EE81M.26.57.F02.1.454.CMB.1.raw
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagcttgggttttccttgttgcttattttaaaaggtgtccagtgtcaggtncagctggtggaggtccgggggagcttggccaggccgggggggtcctgaaactctcatgtgcgaggctcgtggtattcaactattcagtcgactcggctatatacgttggggtcccncgaggttcgtcgggaccggggaaagggcgtgggaggtcggtcgtttcgggaccgttaaagttaacggaaaacccctaaaccgttacgaaacggtaaacgtaccgggacgtaaacttaaattttagtggtccgttaggtccggtacgggtaggtacgaaacgggtcgtaacgggttacccgtaaccctaacttccgtacccgaagggtaacgtagtaggtacgtttacgaaggaaacggaaaccgtacgggtaacgttaacgtaccgttaagaacgtaaaacgtaacggaaacctaaccggtaacccgttaaaccgggaaaacccgggtaaccgggtaaaccggtaacccggggtacccggttaacggtttaaaccgtttaaccggttacggtaccggtaacccgtaacggtaacccgttaaaccgggttaccccggtttaacggtttaaccggtttttaaaccgttttaagtttttttacccggttaaccggggttacccggtttaaccccggg

SEQ ID NO: 59502 - DNA, 753 bp, Homo sapiens
  misc_feature: GYAE6OF01EM3F7.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgcttaatttaaaaggtgtccagtgtcgaggtgcgagtcgtgggtggacgggtccggggggaggtcgttcgggtccgacgggtcccgggggggtccctaggaaaccttccgtcgagttggtcgccgtaggcttcgtaggtacttaccaacgtacgttcgaacggtcgtaacgttccggacttaagtacgttaccggtcgggggtacccnccgtacgttccggtacgggaccgggggaaacgggtcgtagggacggtcgggtcgttacgggtaccggttaataacggaaaccctaaacggtacgaaccgtaacgtacgacgtaactaatttagcgtcgtaggtccggtcgtgacgaagggtctacggtaccactacgtcctacgagaacgagttacgtaacttacgaaggtaccgaaaccggacggtacgttaacgtctacgaactaagtacgaaacgtacgaaccgttaaacggaaccggaacggaccgaacgggtccgtagtacgttacgtcgtacgacgtacgtaccgacgttccggtacgttacgtttaaccgtttacgttttcggaacgttccgggtacccg

SEQ ID NO: 59503 - DNA, 753 bp, Homo sapiens
  misc_feature: GYAE6OF01CR6UL.26.57.F02.1.454.CMB.1.raw
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaagatgtcagtgtcaggtgcagctgggtgggacggtccgggggaggcgttgggtccgaggccgggggggtccctggaaacctctcatgtgcgaggctcgtggaattccanaattcgagtggactcggctatatactgggtccncctagtcgtggccgggaaaagggctagggagtcggcgtttggaccgttaattaacggaaccaaaacgtgaacgtaaacgtacgaccgaaagtaatttaatgtacctggtcggtaccggtgaccgaaagggcgaacggttcaacctaacttacgtaccctaagaaggtaacgtagaatttaccgaaggaacggaaacacccgggtacgttaacgtacgttacgaaaccgaaagttaaccgaaacgaaacgtaacccgtaaacgggaaaaaacccgggaaccgggaaaccggtaaccggggtaacccggttaacggtttaaacgttaaccggttacgggttaccggaaccgaaccggaacgttaacggttacccggtttaaccggtttaactttaaaccgtttaacgtttttttacggacggttttaaacccgggg

SEQ ID NO: 59504 - DNA, 740 bp, Homo sapiens
  misc_feature: GYAE6OF01AM5U3.26.57.F02.1.454.CMB.1.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagctgggttttcctgttgctattttaaaggtgtccagtgtcaggtgcagctggtggagtccggggagcgttggtccaggccggggggtcctgaactctcagtgtgcaggctcgnggtattcactnttcagtgactcggactatagtactcgggtccnccgtagtcgtggaccggggaaagggtccgtagggacggtggtccgttgggacccgttaagtttaaccggaaaccctaaaccgtacgtaaaccgtaaacggtaccggaccggtaacttaaattttacgcggtccgtggtcccggttacggtcgacggaacggtcgtaacggttccaccgttactaccgtaccgagtagtataggtacttacgaggaacggtaacgtaccgggtacgttacgtacctaggtaactaaagtaaccgaacgtaccggtaacccgtaaacgggtaaacccggacggacccgaaccggggttaccgtaacggttaaccgttaacgtcgggtaccgtaacccggtaccggtaacgtaccgttcccggttaacgttaacgttttaacgtttaaccgtttttccaacgggtttccggtaacccgg

SEQ ID NO: 59505 - DNA, 730 bp, Homo sapiens
  misc_feature: GYAE6OF01EUM2J.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaagttttaaaaggtgtccagtgtcgaggtgcagcgtggtggaggtccgggggagcgttggccgagggcccggggggtcctagtaaactctcagtgtgcgacggtctcgtggtacttaccgactatcctaggtacgtacgtcgacttatactaccggtcggcccgcgtacgttcgtcgggaaccgggaagggtccgtagggtacggttcggtcgttacgggtaccgttaagttaaccgaaaccctaaacgtacgaaccgtaaaggtacctaacgtaacgtaatttacgcgtacgtacggccggttacggtacgacggaacggttacgtaacggttcccaaccgttaactccgtaccgtaagacgtagtacgtactacgaacggaacgtaacgacgtcgtaacgtcaacgtaacaaacgacgtaaccgacgtaaccgtaaacggaaaccggacgaaccggtaccggtacgttagtacttacgtcggtaaccacgtaaccgtcgtaccgttacccgttagtttaacccgttagtttaccttttcgaacggttccgtaacccg

SEQ ID NO: 59506 - DNA, 713 bp, Homo sapiens
  misc_feature: GYAE6OF01ELYYL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgtctattttaaaaggtgtccagtgtcaggtgcagctggtggagtccgggggaggcttggtccgaggccggggggtcctgaaacgtctcatgtgcgaggctctggattcactattcagtcgactcggctaatactacgtggtccgcctagtcgtcgccggggaaaggtcgtgggagtggcgttcggtaccgtaagttaacggaaacccaaaccgtagaaccgtaaaggtaccgacgtaaactaaatttactaggtctgggcgttacggttcggacgtaaacgggcgtaacggttacaacccgttactaccgtacctaggtaagtacgtagtaactttacgaaggtaacggtaaacgtaacggtacggttaacttaccgtaacgtactaaaacggttaacgaaaccgaaccgtaaccgttaaacggaaaacccggtaacgggtaaccgaacccgggtaccgtagttaaccgttaacgtcggtacgtacgaacggtaacgacgttacgtacgtttacttaacgtttacttttcggtagttcccggtaccgg

SEQ ID NO: 59507 - DNA, 951 bp, Homo sapiens
  misc_feature: GYAE6OF01AP73W.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggagcgttggtccgaggccggggggtcctgaactctcatgtgcaggctctggattcatattcagtgactcggctatactacgtcgggtcccgcgagttcgtggacccggggaaagggcgtagggacggtgggtcgttacgggtacccggttattaaaccggaaaccctaaaccgtacgaaccgtaaaacgggttaccggaacgtaaaccgttaaagttttacgtcggtacccgttgggtacccgggtttaccgggggttagtaacccgggtaaaacggggtccgtaaccggggttttacccccgaaaccccgttaccgttaccccgtttaacccggaaagggtaaacggtaacggtttaacggttaaaccggttttaaccggaaaagggtttaaaacccgggaaaacccccgggttaaccgggggttaaccggtttaaacccggtttacccgtttaaaccgggtaaccgttaaaaaacgttaccggtaaaaccccggtaaaccggggttaaaccccgttaaaacgggggaaaaaacccccggggaaacggggtaaaccccggtaaccccgggggtacccggtttaaacgggttaaaccgtttaaccgggttacgggttaccggtaacccgtaacggtaaccgtaaacccggtttacccggtttaaccggttttaacgttttaacgggttttaaccctttttttaacggttcgggtttaaccccgggttaaccccgg

SEQ ID NO: 59508 - DNA, 657 bp, Homo sapiens
  misc_feature: GYAE6OF01B6W47.26.57.F02.1.454.CMB.1.raw
  modified_base (426)..(426): a, c, t, g, unknown or other
  misc_feature (426)..(426): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctgggtgggaggtccgggggaggcgttggtccgagggcccgggggggtccctggaaactctacatgtgcgaggctcgtggattcactattcagtgactcggctatatacgtgggtcccgccagtcgtggacccggggaaagggccgtagggagtgggtcgttcgggaccgttaattaacggaaaccctaaaccgtgaacctaaggtaccgacgaactaatttanggctggcggttcggtcgcgaacggcgtacggtaccacctactcctacgagatagtagtattacgaagaacgaaccgacggtacgttatcgtacgacaaagtacgaacgtacgaccgtaaacgaaacgacggaccgaccggtcgttagtacttacgtcgtccgacgaacgtacgtacgttacccgttacgttacgtttaaccgtttatttttccgtaacggttcggtacccg

SEQ ID NO: 59509 - DNA, 633 bp, Homo sapiens
  misc_feature: GYAE6OF01DGAOQ.26.57.F02.1.454.CMB.1.raw
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagctgggttttccttgttgctatttaaaaggtgtccagtgtcaggtgcagctggtggaggtccgggggagcttggccgaggccggggggtccctgaaacctctcagtgtgcaggtctcgtggattcacattcagtgactcggactatatacgtgggtccgccagtcgtggaccggggaaggctgggagtgctggccgtaatacgaacaactgaacaagtacacgataattagngtcngcgtgtgacaggtcaggtcactatctacagagagtagactcgagtaacggaacgacggtctactacgtagaacgtaaagtagaaaccacggtaccgtaaacgggaaaacccggagggaacccgtacgggtacccgttagtaacgtttacgtggtaccgtaccggtaacgtaccgtaaccgttacccgggttaccgttaaacgttttaaccgttttagtttttaaccggtaggttccggttaacccgg

SEQ ID NO: 59510 - DNA, 576 bp, Homo sapiens
  misc_feature: GYAE6OF01AQOSC.26.57.F02.1.454.CMB.1.raw
  modified_base (395)..(395): a, c, t, g, unknown or other
  misc_feature (395)..(395): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactcgtcatgtgcaggctcgtggattcacattcagtgactcggactatatacgtcgggtccgccagtctggccgggaaagggctggagtggcttggaccgtattaacgaaccaaaccgtgaacaacgtacgacgtaactaaatttangtcctgcgtcggtgacgaaggcgaggttcaccatctcagagatgtattacgagacgaacgacggtacgtatctagacaagtagaacgacgacctaacgaaaccgacggacgaccggtcgtagtacttacgtgtcgacagacacgtccgtacgttacttacgttattttcgagttcgtaccg

SEQ ID NO: 59511 - DNA, 680 bp, Homo sapiens
  misc_feature: GYAE6OF01BG2BN.26.57.F02.1.454.CMB.1.raw
  modified_base (196)..(196): a, c, t, g, unknown or other
  misc_feature (196)..(196): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttggttttcctgttgctattttaaaaggtgtccagtgtcaggtncagcgtggtggagtccggggagtcgttggtccgaggccggggggtcctacggaaacctctacgagttgtcggacacgggcttcgtggtacttccgactacgttcgaagttcgacgtcggtacttaatacgtaccgtcgggtcccgaccgtagtcgtcgggaccgggtaaggcgtgggagtcggtcgttggaccgtaagtaacggaaccaacgtagaactaacgtacgacgaacttaattagtcgcgtagcgttcggacgtacgaggtcctaaggttcccaacgtacgtccacgagacgtatacgtatacgagtaacgaacgtcgactacgtactacgaactaagtacgaaccgacggtactaaccggaaaacggtcgaacgaccggttacgtaagttacgtacgtccggtcgtaaccgcgtacgtaccgttccgttaacgttaagttacccgtttagtttaaccgtggttccccggttaaccgg

SEQ ID NO: 59512 - DNA, 866 bp, Homo sapiens
  misc_feature: GYAE6OF01CMDXQ.26.57.F02.1.454.CMB.1.raw
  modified_base (203)..(203): a, c, t, g, unknown or other
  misc_feature (203)..(203): n is a, c, g, or t
tcagagactatactcacgaccggtgctcgatttagctcgatatagttgggtttggggctgggagaggagctccagcccttgggattcccagctgtctccactcggtgatcggcactgaatacaagagactcaccatggagtttgggctgagctggttttcctgttgctattttaaaaggtgtccagtgtcaggtgcagctggnggaggtccgggggagcgttcgggtcccgacgggcccgggggggtccctaggaaaccttctccgattggtcgccgagggtcctcgtggtaacttcacctaatttccgaggttagacgtcggacttaacgtagttaccgttcggggttccccgacccgtacggttccgtacgggaacccgggggtaaacgggtccgttagggaggtcgggtccgtttcgggtacccgttaactttaaccggaaaccctaaaccgtcggaaacctaaacggttcggaaccgtaaccttaaagtttacgacggtccgtacggtcggttacggtacgaaccggtaacgggtccgtaaggttacccaacccgtataccccgttaccgaaggtagtacgtacgtacttaccgaaaggaaccgtaaaccggtaccgggtaccgtttaaccgttacgtaccggtaaacgtaacgtaaaccgacccgtaaaccggtacccgttaaaccgggaaaaccccggtaccggaacccggtaacgggttacccgttaggttaaaccgttaccggtacggtacccgtacccggtaaacgtcccgttaaacccggttccccggttaaccgtttaaacgtttttacccggttttaatttttaccccggagggttttcccggttaaaccccgg

SEQ ID NO: 59513 - DNA, 788 bp, Homo sapiens
  misc_feature: GYAE6OF01CSCQD.26.57.F02.1.454.CMB.1.raw
  modified_base (510)..(510): a, c, t, g, unknown or other
  misc_feature (510)..(510): n is a, c, g, or t
tcagagactatactcacgaccggtgctcgatttagctcgatatagttgggtttggggctgggagaggagctccagccttgggattcccagctgtctcccactcggtgatcggcactgaatacaagagactcaccatggagtttgggctgagcgttgggttttccttgttgacttattttaaaaggtgtccagtgtcaggtgcagctggtggacggtccgggggagtcgttggtccgacgggcccggggggtccctagaaacctctactagtgtcgacgtaggccttcgtaggtacttaccaactatttaccgagttcgaaccgttcggtaccttaagtacgttaaccgttcggggttcccccgacccgtaaggttccgttacggggaaccccgggggtaaagggtccggtagggtacggtcgggtccgttcgggtacccttaacgttaacgaaacccgtaaaccgttagaaccgtaaacggttaccgacggttaaacttaagttttacgngtaccgtcggtaccggttcggggtagcccgaagggccggttacgttacccaccctacgtacccgtaccgaaggtagtatacggtacttacgaaggaacgaaccgtacgacgttaacctgtaacgaataaacgtaacgaacgtacggtaccgtaacggaaaacccggacggtaccgtaccgggtcttaaggtacctttacggacggtactaccgaacgtcgttaaccgttcccggttaattacgttttaacgtttatttacgccgggtttcgtaacccg

SEQ ID NO: 59514 - DNA, 912 bp, Homo sapiens
  misc_feature: GYAE6OF01DMBOK.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagcgttgggtttttccttgttgacttaagttttaaaaggtgtccagtgtcgaggtgcagcgtgggtggacgggtccgggggaggtcgttcgggtcccgacggggcccgggggggttccctacggaaaaccgttcctaccagttggtcgcgacggtccgttcgtaggtacttaccactagttccgaggtcgtaccgtcggacttaattaacgttaccgtcggggtccccgtacctaagggttccgtacggggtaacccgggggtaaagggtccggtagggtacggtcgggttacggttcgggtaacccgtttaagtaaaccgaaaacccgtaaaccgtacgtaaaccggaaacgtaaccggtaacgtaacctttaaagtttagtcggtaccgttcggtcgggttacggtacggtaaccgtaacgggtcgtaacggttacccaacccgttacttccgtacccgtaagtaacgtagttacgtaacttacggaaacggtaacggaaaccggaccggttacgtacttacgtaacgtaaacgtaaaccgttaacgaaaccggtaaccgtaacccgttaaacccgggaaaaccggtaaccgggtaacccggtaaccgggttacccgggtttaaacgtttaaaccgtttaaccgtacggtaccggtacccgtaaccggtacccgttaccgttacccggtttaaccggtttaaccgtttttaaacggttttaccggtttttaccgttaaccggggttcccggtttaaccccggg

SEQ ID NO: 59515 - DNA, 696 bp, Homo sapiens
  misc_feature: GYAE6OF01CKCOG.26.57.F02.1.454.CMB.1.raw
  modified_base (448)..(448): a, c, t, g, unknown or other
  misc_feature (448)..(448): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttggttgcttaagttttaaaaggtgtcagtgtcaggtgcagcgtgggtgggaggtccgggggaggcgttggtccgagggcccgggggggtccctaggaaactctcagtgtgcgaggctcgtggattcacattcagtcgactcggctatatacgtgggtacccgccaggtcgtggacccggggaaagggccgtagggaggtgggtcgtttggggacccgttaattaacggaaaaccctaaaccgtagaaacgtaaacgtaacggaccgtaaacgtaaattttacgnggtccgttggaccggttacggtcgaacgaagggtcgtaacgggttaccacccgtattacctaccgaagtagaactaggtacttacgaagagaaccgacggacgtactacgtagaacgtaaagtacgaacgaacgacgaacggaaaccgacggacgaacgggtccgtaggttaacttacgtacggtcgaaccgagacccgtactaccggttacgttatttaccggttatttttacgaggttccgtaccg

SEQ ID NO: 59516 - DNA, 896 bp, Homo sapiens
  misc_feature: GYAE6OF01AKBW6.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacaagagactcaccatggtagtttgggctgagtcgttgggttttccttgttgtacttaagttttaaaaggtgtccagtgtcgtaggtgcaggtcgttgggtcggacgggtaccgggggagtccgtttcgggaccggtacggggtcccggggggttaccctaggtaaaccgttccgtacgtagttcggtacgacgacggtccttacggtcggtacttaccgactacgtttccgaggttccgtaccgttacggtacttaacgttaccgttaaccggttccggggtaccccgtacccgtaacggtttacccgggtaccggggtaaacccgggggtaaaccgggttcgggttacgggtacgggtttaccgggttcgggtttaaccgggtacccgttttaaaacgttaaccggaaaaacccccgttaaaccggtacggtaaaacccgttaacgggtaacccgtaaccgggttaaacctttaaacgttttaaccggtacggtaccggttaccgggtaccgggttaccggttaacggaacgggtaacccgttaaccgggttacggttacccgaaccgtcgttaccgtaccgtaagtaacgttacgtacgtaagtacgaacgaacgtaacggcgtacgtatacgacgtaacgagtaacgacgaccgtaacgaaccgtaaacgcggtaccgaccgtacgtacgttacgtcgtacggtccgactacgtaccggttactaaccggttacgttacgttaacgtttaccgttcgtacggttcccgtaacgg

SEQ ID NO: 59517 - DNA, 754 bp, Homo sapiens
  misc_feature: GYAE6OF01EF2FQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtaggtttgggctgagcgttgggttttccttgttgtcttaagttttaaaaggtgtccagtgttcgaggtgcaggtcgtgggtggacgggtccgggggagtcgttggtccgacgggccggggggtcctaggaaactctctagtcgtgcgacggtctcgtgtactactactagttcgtacgtcgtaccgtcgtacttagtacgtaccggtccgggtccgtaccgtacggtacggacggggacgggaacgggtcggtaggtacggtcggttaccggttacggtaaccgttaagtaaccgaaaccgtaacgtacgtaaacgtaacggtacgtaacgtaacttaagttagcgtcgtcggtcggtaggacgacgtacgtaccgtacgtacctaccgtacgtaccgtacgagtaagtactacgtacgtacgaaggaaacgtaccggtacggtacgtacgtacgtagaacgtaacgtaacgaacgaccgtaaccgtaaacggaaccggtacggaccggtacggtacgttacgttaactacggtacggtaccgaccgtacgttacgttaccggttaaccgtttacgtttaacgtttaacgtttactttacggtcggttaccggtcg

SEQ ID NO: 59518 - DNA, 641 bp, Homo sapiens
  misc_feature: GYAE6OF01DTQIV.26.57.F02.1.454.CMB.1.raw
  modified_base (310)..(310): a, c, t, g, unknown or other
  misc_feature (310)..(310): n is a, c, g, or t
  modified_base (388)..(388): a, c, t, g, unknown or other
  misc_feature (388)..(388): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtgggaggtccggggggaggcgttggtccgaggccgggggggtccctgaaactctcatgtgcaggctctggattcacattcagtgactcggctatatacgtgggtccnccagtctcggaccgggaagggctgggagtggcttggccgtatacgaaccaacctgaacaagtacgcgaactaatttangctgcggtcggtagcgaaggcgtacgggttaccacctacttcctacccgaggtagtatacgtattacgaagaacgaacgaccggtcgtactcgtagacaaacgtacgaacgacgaccgtaaccggaaaaccggacggaccgaccggtaccgttaaggtacgttacgttcggtacgtaccgacgaccgtacgttccggttacgtttaacgtttaacgtttacgttttttacggtacggttccggttaaccccgg

SEQ ID NO: 59519 - DNA, 783 bp, Homo sapiens
  misc_feature: GYAE6OF01EHDQJ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctggagcgttgggttttccttgttgacttaagttttaaaaggtgtccagtgtcaggtgcagcgtggtggacggtcgggggagtcgttggtccgacgggtccggggggtccctagtaaacctctcagtgtgcgaggtctgtggtacttacactattcgagtcgacgtcgtactagtagtacgtcgggtccgcgagtcgtcggacgggtaacggcgtagggagtggtccgttagggaccgttaattaacggaaacctaaaccgtacgaaaccgtaagaccgtacgtaagttaactttagtcggtacgtacggtcggtccggtacgacggtaaacggtcgtaccggtttaccactacgtcttacccgagaacgtagtagtaacgttacgaacggtaacgaacgtacggtacgtacgtacggtaacgaacgtaaacgtaacgtaaacccgtaacggtaacccggtaaaccgaaacccgggtaacgggaacccggttaaccgggtaaccggtttagttaaaccgttaccggtaggttacccggaaaccgttacgtaaacccgttaacggtttacccccgtttaacgttttaacggttttaacgttttaacctttttcgggtaacggttcccgggtttaaccgg

SEQ ID NO: 59520 - DNA, 797 bp, Homo sapiens
  misc_feature: GYAE6OF01BN73L.26.57.F02.1.454.CMB.1.raw
  modified_base (782)..(782): a, c, t, g, unknown or other
  misc_feature (782)..(782): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctatttaaaggtgtccagtgtcaggtgcagcgtggtggaggtccgggggaggtcgttggtccgaggccggggggtcctgaactcgtcagtgtgcgaggctcgtggattcactattcgagtcgtactcggctatagtacgtcggtccgcgtagtcgtcggacggggaaaggtccgtagggacgtcgggtcgtttacgggtaccgttaagttaacggaaaacccgtaaaccgttacggaaaccgtaaacggtaccggtacgtaaacgttaaagttttacgtacggtccgttacgggtccgggttaccgggttacggtaaccggtaaacggggtacccttaacggggtttaccctaaccccgttaaccgttacccctttaacccggaaaggtaacgggttaacgttacggttaaccgtttacgaaaggtaaccgggtaaaccgtaaccgggtaaccggttacttaccggtaacgaaccgtaaacgtacggaaaccgtaacgtaacccggtaaacggaaaccgggacggaaccgtaccgggtacgttacgttaacgttacgtggtaccgacgtacgtaccacgttccggtaacgttacgtttaaccgtttagttttacgnggttcggtaacccgg

SEQ ID NO: 59521 - DNA, 628 bp, Homo sapiens
  misc_feature: GYAE6OF01CE4G2.26.57.F02.1.454.CMB.1.raw
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (195)..(196): a, c, t, g, unknown or other
  misc_feature (195)..(196): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (336)..(336): a, c, t, g, unknown or other
  misc_feature (336)..(336): n is a, c, g, or t
  modified_base (393)..(393): a, c, t, g, unknown or other
  misc_feature (393)..(393): n is a, c, g, or t
tcagagactatactcacgaccggtgctcgatttagctcgatatagttgggtttggggctggggagaggagctccagccttgggattcccagctgtctccactcggtgatcggcactgaatacaagagactcaccagtggtaggtttgggctggaggcggtcggttcgtgtaggctattaaagtgcagtgtngngnngcnggnggnggtcgggngtctgcgcggccggggtcagaactcngagtgtgcgtggcctagtgacttcatacttcgaagtcgcctcgatttagcgtcgtcggtcgaccgttggtccgagggaaccggacggtcggtagggngtcggttcgcggtacgttagaaaccacgtaaccagtaacgagtacgactataatcgngcgtcgacgtgacgagtacggtactacgtactacgtcgtacagaagtagttagtacgaagtacgaacggaacgtaccgtacgtacgtacgtacgtacgtaacgtaacgtaacgtaaccgtaaccgtaaccgaacggaacggaacgacggtacggtacgtacgtacgtacgtacgtacgacgtacgtcgtacgtacgttacgttacgttacgtttacgttacgttcgtacgtacgg

SEQ ID NO: 59522 - DNA, 811 bp, Homo sapiens
  misc_feature: GYAE6OF01DE2AU.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtaccagtgtcaggtgcagctggtggaggtccgggggaggtcgttggtccgacgggcccgggggggtacccctaggaaaccttctcagtggtcgcgaggtctcgtaggtattaccactatttaccgagttcgtaccgttcggacttaatacgtaccggttcggggtccccgaccgtagtccgtacgggacccgggggaaagggtccggtgggtacggtgggtccgttacgggaccttaaacgttaacgaaaacccgtaaaaccgttggaaaccgtaaacggtaaccggaccgtaaacgtttaaatttaacgtcgtcgtacgggtcggtacgggtacgacggtaacgggcgttaacggttaccaacccgtatcccgtaaccgaagtagtaagttacgacgttacgaaggaaaccggaacgtacggtacgtttaacgtacgtacgaacgtaaacgtacgaaaaccgaccgggtaaccgtaaaccgggaaaacggaccgggaccgtaccgggtaaccgttacgtaaccgtttacggtgtaccgacgtaacggaacttacccggttaccggtttaacgttaacgttttaaacgttttagtttttaccggacggtttccggttaaacccggg

SEQ ID NO: 59523 - DNA, 907 bp, Homo sapiens
  misc_feature: GYAE6OF01B9QNL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttctgttgcttattttaaaaggtgtccagtgtcgaggtgcaggcgtgggtgggaggtccggggggaggtccgttcggtccgacgggcccgggggggttccctacggaaacctcctctagtgtcgcgacggcctcgtaggtacttccacgtacttcgaggtcgtaccgtccggtactaattacgtaccggtcgggtcccgccgtagtcgtacgggacccggggaagggtccgtagggaggttcgggtcgttgggtacccgttagtaaccgtaaacccaaaccgttaggaaacctaaacggtacggaaccgtactttaaagtttacgtcggtccggttacggtacccggttagggtacgtaaccggtaaccgggtaccgttaacgggttaccccaacccgttacgttaccccgtaccgtaagggtaaacgtacgtttacggtaaccgttaacgaaacggtaaaccggggtaaacccgtaccggggtaaccgtttaagtaccgttacggaaacttaaacgtaacggaaccgtaaacccgggtaacccgtaaaacggggtaaaaacccgtaccggggaaacccggttaaccgggtcccggttttaaggtttaccctttaaacccgggtcgggtaacccgtaaacccggtaccggtaaaccgttacccggttaaccccgttttaccggtttaaacggttttaaccggttttttacggtttttacccggtcccgggtttcggtttaaacccccgg

SEQ ID NO: 59524 - DNA, 648 bp, Homo sapiens
  misc_feature: GYAE6OF01DSVD7.26.57.F02.1.454.CMB.1.raw
  modified_base (314)..(314): a, c, t, g, unknown or other
  misc_feature (314)..(314): n is a, c, g, or t
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
  modified_base (634)..(634): a, c, t, g, unknown or other
  misc_feature (634)..(634): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtggaggtccggggggaggcttggtccgagggcccgggggggtccctgaaactctcatgtgcaggctctggattcacattcagtgactcggctatatactggggtccnccaggtctggcgggaagggctgggagtggcttggccgtatacgaaccaaactgacaagacgacgataatttangtctgcggttcggtgacgaaagggctaaggttccaaccacgttctaccaagganaagtgacttacgaaggaacgaaaccgaccgggcgttaactctaggacaaaagtacgaactacggaacccgtaacgggaaaacccggaacgggtaccgaaccgggtaccggtacgttaaacgttacgtcggtaccgacccgaacggtaacctacgttacccgttacgttacgtttaacgttttatttttaccgnggttccggtacccg

SEQ ID NO: 59525 - DNA, 616 bp, Homo sapiens
  misc_feature: GYAE6OF01DIA71.26.57.F02.1.454.CMB.1.raw
  modified_base (399)..(399): a, c, t, g, unknown or other
  misc_feature (399)..(399): n is a, c, g, or t
  modified_base (548)..(548): a, c, t, g, unknown or other
  misc_feature (548)..(548): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggaggtccggggggaggtcgttgggtcccgagggcccggggggggtcccctagaaacctctcatggtgcaggctctggattcacattcagtgacgtcggctatatacgtgggtccgccagtctggccgggaaagggctggagtggcgttggccgtattacgaaccaaacctgaacagtacgcgactaatttangctgtcgtcggtgacaagggcgtaggttccaccatcctacgagagaatgattacgaagacgaaccgacggacgttagtctagacaaagtcgaaacgtacgaccgtaacggaaaccgacggaccgacgggtaccgttagttacgtttacncggtacgaccgagacctacgttccgttacgttactttaacgttagtttttacaggttcggttaacccg

SEQ ID NO: 59526 - DNA, 863 bp, Homo sapiens
  misc_feature: GYAE6OF01ECR0Y.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttcctgttgtacttagtttaaaggtgtccgagtgtcaggtgacagtcgtgggtaggacgggtccgggggaggtcgttcggtccgacgggcccgggggggtacctaggaaacctcgtctagtggtacgacgtagggtcttcgtaggtacttaccgaacttacgttacgaggttaccgaccgttaccggtacttaacgttacgttaccggttccggggtccccgtaccgtaacggttccggtacggggacccgggggtaaagggtccggttaggggacggttcgggtaccgttacgggtacccgttaaacggttaaccgaaacccgtaaaccggttcaaacggtaacggtacccgaacggtaaccttaaagtttacgtcggtccgtacggtaccgggttcggtacgtaccggtaacgggtaccgtacgggttacccaaccgtaacgtcctaacgggaagtacggtaacgtcgtaaccgttacggaacggtaaccgaacggtacgggtactaagttccgaaggtaaccaaggttaccaacggtaccgtaaccgtaaaccgggtaaaaccggccggtaccgtaacgggttcccgttaagttacggttacgttcgggacccgtacgtaaccggtcgttaacccggttaccggtttaacgttaacgttttaccgtttaaccgttttacggaccgggttcccgttaccgggg

SEQ ID NO: 59527 - DNA, 875 bp, Homo sapiens
  misc_feature: GYAE6OF01DZW8N.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtaggtttgggctgagtcgttgggttttccttgttgtactttaagttttaaaaggtcgtaccaggttgtcgaggtgacgagtcgtggggtgggacgggtccggggggagtcgttcggtccgacggggtcccggggggtccctaggaaaccttcgtacgtagtgtcggacgtaggtctcgtaggtacttccgaactacgttacgtacggtcggaccgttacggtacttaagttaacgttacggttccggggtacccgaccgttacggttacggtaccggggtaaccggggggaaagggttcggtacggggtagggttcgggttccggttacgggtacccgtttaaacgtaaaacccggtaaaacccgtaaaccggttaggaaaaccggtaaacgggttaacccgaacggttaaacttttaaacgttttcggacggttaccgttacgggtaccggtttacgggtaccgtaaccggaacgggttaccgttaacggttacccaaccgttacgtacccgtaacggaagtaacgtagttacgtagtaacggaaggtaaacgaaccgtacggtacgttaactacggtaagaacgtaaagtacgaaacgtaaccggtaaaccggtaaacggaaaacggtacggaaccggtacggtaccgttagttaccgtacgtacggtacaaccgtagtaacctcgttaacggttcgttaatttaccggtttagttttaccggagttcgtaccgg

SEQ ID NO: 59528 - DNA, 611 bp, Homo sapiens
  misc_feature: GYAE6OF01ANSRA.26.57.F02.1.454.CMB.1.raw
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (474)..(474): a, c, t, g, unknown or other
  misc_feature (474)..(474): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggagtccggggggaggcgttggtccgaggccgggggggtccctgaaactctcatgtgcaggctctggattcacattcagtgactcggctatatacgtcgggtccgccagtctggaccgggaagggcgtggagtggctgggtccgtattaacgaacctaaacctgaacaagtacgcgaactaatttangctgcgttcggngcgaaggctaggttcacactctccagagatgtattcgaagagaacgacggacgtagctacgaacgtaanagaacgacgaccgtaacgtaaaccgaacggaccaccggtaccgtagttaacgttacgtacggtacggaccgaacgaccctacgtcccgttacgttaacgttttaccgttactttttacgtaggttcggttaccccgg

SEQ ID NO: 59529 - DNA, 718 bp, Homo sapiens
  misc_feature: GYAE6OF01EIUJ5.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagcgtggtggaggtccgggggaggcgttcggtccgacgggcccgggggggtccctagaaacctctcagtgtgcgaggtctcgtggacttcacgtattcagtgactcggtctaatataccgtgggtccgaccagtcgtcggaccggggaaaggcgtgggagtggtcgttcgggccgttaagtaacgaaacctaaaccgtgaaccaaggtaccgacgaactaatttagcgcgtgcggtcggtgacgaaggtcgaggttccaccgtactccgtccagagatagtattcgaacggaagaaccgacgggtacgtaacgtacctacgaactaaagtacgaaaccgacgtaacccgtaaacggaaaacccgggacggaacccggtaccgggttaccggttacgttaacgttaaccgttacggtaccggtaccgaaacggtaaccgaacccgtttacccgttaacggtttaacgtttaaaccgttttaacgtttttttaccggacggtttacccggttaaccccgg

SEQ ID NO: 59530 - DNA, 585 bp, Homo sapiens
  misc_feature: GYAE6OF01BEY7P.26.57.F02.1.454.CMB.1.raw
  modified_base (379)..(379): a, c, t, g, unknown or other
  misc_feature (379)..(379): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcgttggtccgaggccggggggtcctgaaactctcatgtgcaggctctggattcactattcagttgactcggctatatactgggtccgcagtcgtgccgggaaggctggagtggcttggcgtatacgaaccaacgtcgacaagtacgacgacaagtttacgngtctcgcgtcggtcgcgaacggtcgtaggttccaccgtactctaccgagagatagactcaagacgaacgacggacgtaatcgtagacaaagtacaacgtacgacctacggaaaccgaggaccgacggccgttagtacttacgcgtcgaccgagtaccacgtaccgtacgttaacttacgttacgtttttctacggttcggtacccg

SEQ ID NO: 59531 - DNA, 925 bp, Homo sapiens
  misc_feature: GYAE6OF01D8V00.26.57.F02.1.454.CMB.1.raw
  modified_base (392)..(392): a, c, t, g, unknown or other
  misc_feature (392)..(392): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgacttaagttttaaaaggtgtccagtgtcgaggtgcagctgggtggaggtccgggggagtcgttcgggtccgacggggtcccgggggggtaccctacggtaaaaccttccgtacgaagttcggtagccgtaggtccgttacggttaggtactttaccgattaacgtttcgaacggttcgtaccgttcgggtacttaagttacgttaccggttcgggtaccccncgtacggttccgtacggggaaccgggggaaaggtcggtacgggtaggttcgggtaccgtttcgggtacccggtttaaacgttaaccggtaaaacccaaaccggttcgaaaccgtaaaacgggtaacccgtaccgtaaaaccgtttaagttttaacgtacggtcggtaccgggttaccgggttacggttacggaaaccgtaacggggtaccggttaacgggtttacccaacccgttaacgttaccccgtaacccggtaaaggtaagacgttaacggtaacttacccgggaaaggtaaccgaaaccggtaaccgggttacgttaacgttacgtaacgtaacgtaaaccgtacgaaaccggtaaccgtaaccgggttaaaacggaaaccggtacggaaacccggtaccggttaaccgttagtttaaccgtaacgttacggaccggtaacccggtacgtaaccgttaaccggttcccgtttaacggttaaccttttacggttttaacgtttttacccggagggttcccgttaaccgg

SEQ ID NO: 59532 - DNA, 667 bp, Homo sapiens
  misc_feature: GYAE6OF01DIREZ.26.57.F02.1.454.CMB.1.raw
  modified_base (130)..(130): a, c, t, g, unknown or other
  misc_feature (130)..(130): n is a, c, g, or t
tcagagactatactcacgaccggtgctcgatttagctcgatatagttgggtttggggctgggagaggagctccagccttgggattcccagctgtctccactcggtgatcggcactgaatacaagagactnaccatggagtttggctgagctggtttccttgttgctatttaaaggtgtccagtgtcaggtgcagctggtggaggtccgggggagcgttggtccgaggcccggggggtccctggaaactctcatgtcgcaggtctctggattcacattcagtgactcggctatagtaccgtcgggtccgccagtcgtaggtcgggaaagggctagggagtggcgttaggccgtaagtttaacgaaaccctaaacgtcgaaaccgaaggtaccgaccggtaactaaactttagtacgtctaggtcgtcggtagacgaaaggtcgtaacggttaccaccctattccctaccgtaggtaagaacgttaggtaacttacgaagtaacgaaaccgacggtacgttactcgtagaacgtaaagtacgaaacgtacgtaccgtaacggaaaccgaacggacgtaccggtaccgtaggtaacttacgtcggtacgactacgactaccgttaccgtacgtttacgttaacgtttacttttacgtgttcggtaacccg

SEQ ID NO: 59533 - DNA, 590 bp, Homo sapiens
  misc_feature: GYAE6OF01CCADW.26.57.F02.1.454.CMB.1.raw
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctgaaactctcatgtgcaggctctggattcacattcagtgactcggctatatacgtgggtccnccagtcgnggacccggggaaagggcgtagggaggtggtcgttcggaccgttaattaacgaaacccaaacctgaacctaaaggtacgacgaactaatttaatgctggcgttcggtgacaaggcgagttccacctactctccagagtatgtattcgaagaagaacgacgtacgtatctagacaagtagaacgacgaccgtaacggaaaccgacggacgaccggtcgtagtattacgtgtcgtacagacacgtccgttacgttactttacgttatttttcagtcgtaccg

SEQ ID NO: 59534 - DNA, 657 bp, Homo sapiens
  misc_feature: GYAE6OF01BKTMC.26.57.F02.1.454.CMB.1.raw
  modified_base (463)..(463): a, c, t, g, unknown or other
  misc_feature (463)..(463): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccgggggaggtcgttggtccgagggcccggggggtccctaggaaactctcatgtgcgaggctcgtggtattcactattcgagtcgtacctcggacttatacgtacgtcgggtaccgccgtagtcgtcggaccgggaaggtcgtgggaggtcggtcgttggtaccgttaagttaacgaacccaaaccgtgaactaacgacgactaactaatttagcgcgtgcggtggtagacgaagtcgtacggttcacctntccgtaccgagtatagtagtacgtacgaaggacgaacgtacggtagtaactcgtagaactaagtacgaacgacgtacccgtaaacggaaccggtaacggacgacggtccgttagtacgttacgacgtccgtacgacggtacctacgttccgtacgtttaacgtttacgttacttttacgcggttccgtaaccgg

SEQ ID NO: 59535 - DNA, 931 bp, Homo sapiens
  misc_feature: GYAE6OF01EFF8N.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtagtttgggctggagtcgttgggttttcctgttcgtactttaagttttaaaaggtcgtccgtaggtcgttcgaggtgcgaggtcgtgggtgggacgggtccgggggagtcgttacgggtccgacggggtcccggggggtcctagtaaccgtcgtcagttgtcggacgtggtccttgttacggtactttaccgaacgttagtttaccggtaaggtccggtacgtaccggtacttaacgttacgttaaccgggttcggggtacccctccggtaacggttcccggtaccggggaacccgggggaaacgggttcggtacgggtacgggttcgggtacccggtttacgggtaacccggtttaaacgttaaaccggaaaaccccgttaaacgtacggtaaacgttaaaaccgggttacccggtaaaccggtaaaacttttaaacgttttcgggtacggtaccggtttaccggacggggttttacccggggtaacggaaacggttaccgggtacccggttaacggttaccccgtaaaccctacgtttaacccgtaccggaaggttaaccgtaaggttaccgtaaccggttaacggaaccggtaaacggtaaaccgtacccggttagggtaaccttacggaacgttaaacgtaaacggtaaccgaacggtacccgtaaacggtaaaccggaaacccggtacggaaccggtaccggtagttacgtaccgttacgtcgtccgacgtacgtaccgttcgttaacccgtagttacgttagtttaaccgtttcgaggtccgttacg

SEQ ID NO: 59536 - DNA, 796 bp, Homo sapiens
  misc_feature: GYAE6OF01EARMI.26.57.F02.1.454.CMB.1.raw
  modified_base (200)..(200): a, c, t, g, unknown or other
  misc_feature (200)..(200): n is a, c, g, or t
  modified_base (453)..(453): a, c, t, g, unknown or other
  misc_feature (453)..(453): n is a, c, g, or t
  modified_base (521)..(521): a, c, t, g, unknown or other
  misc_feature (521)..(521): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaggtgtccagtgtcaggtgcngcgtggtggaggtccgggggagcgttggtccgacgggcccggggggtccctaggaaacctctcagtgtgcgagctcgtggtattccgactacttcagtgtaccgtcggtactaatacgtacgttcgggtcccgaccgtaggttccgtacgggacccggggaaagggccgtgggtagtcggtcgttgggaccgttaagttaacgaaacccgaacctacggaactaaaggtaccgacgtaacgtaaactttacgngtccgtacggtcggtcggtacgacgtaagggtcgtacgttaccgtaccctacgtaccgtaccgtaagngtaactagtaacttacgaaggttaaacgaaccggtcggtacgttaacgttacgtacgaaacgtaaacgtaacggaaacgtacccgggtaaaccgtaaaaccggggaaaaccccggaacggaacccgtaaccggggtaccgttaaaccggtttaacggttaaccgttccggttaacggaccctaacgggtacccgttaacccgttaccggtttaaccgttttaacgttttaaccggtttttacgtttttaccgttacggttcccgggttaaacccg

SEQ ID NO: 59537 - DNA, 764 bp, Homo sapiens
  misc_feature: GYAE6OF01BEE3O.26.57.F02.1.454.CMB.1.raw
  modified_base (201)..(201): a, c, t, g, unknown or other
  misc_feature (201)..(201): n is a, c, g, or t
  modified_base (490)..(490): a, c, t, g, unknown or other
  misc_feature (490)..(490): n is a, c, g, or t
  modified_base (589)..(589): a, c, t, g, unknown or other
  misc_feature (589)..(589): n is a, c, g, or t
  modified_base (695)..(695): a, c, t, g, unknown or other
  misc_feature (695)..(695): n is a, c, g, or t
tcagagactatactcacgaccggtgctcgatttagctcgatatagttgggtttggggctgggagaggagctccagccttgggattcccagctgtcctccactcggtgatcggcactgaatacaagagactcaccatggagtttggctgagtcgttggttttccttgttgactttagttttaaaaggtgtcagtgtcaggtncagcgtgggtggaggtccgggggagtccgttggtccgacggggccccgggggcccctaggaacctcgtacgagtgtcgcgtcggtctcgtggtacttcacgtatcgaggtcgtacctcggacttagttacgtccggttcgggtaccccgtcggtacgtttccggacggggtaaccgggggaaagggtccggttaagggtacgggttcgtaccgggttccgggtaccgttaagttaaccggaaacccgtaacgtagaacgtaacggtacgtacgtaacctaaagtttcgnggtcttggtcgtcggtaacgtacgaacggtcgttaaccggtctacctcgtaccacgagtagaactagacgtacgaagtacgaaccgcggtataccgttnaacgaccgaaagtacgaccgtaaacgtacggaaaaccgggaaaccggtcggaaccggtaccggaccgtttaagttaacggttaccgttaccggtacgaacccggtntaacccggttacgttacccgtaagtttaccgtttaccgttttaacgtttcgtacgggttccggtaaccg

SEQ ID NO: 59538 - DNA, 737 bp, Homo sapiens
  misc_feature: GYAE6OF01DSKYP.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgcttaattttaaaaggtgtcagtgtcaggtgcagctggtggagtccggggagcttggtccgaggccgggggtccctagaacctctcatgtgcgagctctggattcacattcagtcgactcggactatatacgtcgggtccgccgagtcgtcggaccggggaaaggccgtgggagtcggtcgttaggccgtaagttacgaacctaaacctgaacaaacgtacgacgaactaaatttagtcgtcgtggtccggtcggttagacgtaaacgggccgtacggtttaccaacccgtacgtacccgttacccgaaggtacggtaataggtaaccttacgaacggtaacggaaaaccgtacgggtaccgtttaacgtccggttacgaaccgtaaaacggtacggtaaaccgaacgggtaaccccgttaaaacggaaaacccggtaacgggacccgtaaccgggtacccgttagttaaacgttcgtacggtaccgtaccgaacggtaaccgttaccgttacccggttacgtttaaaccgtttacgtttagtttttacgtacggtttcgtaaccccgg

SEQ ID NO: 59539 - DNA, 587 bp, Homo sapiens
  misc_feature: GYAE6OF01A8OO9.26.57.F02.1.454.CMB.1.raw
  modified_base (306)..(306): a, c, t, g, unknown or other
  misc_feature (306)..(306): n is a, c, g, or t
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttggtccaggcccgggggggtccctgaaactctcatgtgcaggctctggattcacattcagtgactcggctatatactgggtccncagtctggccgggaaggctggagtggcttggccgtattagaaccaacctgacaagtacgcgaacaatttangctggcgtcggtgcgaaggcaggttcaccgtntcctccagagagtgattcagaacgaacgacggacgtatctagacaagtacgaacacgtaccgtaacgaaaaccggacggaccgaaccggtccgtagttacttaccgtagtcgccgaagtacctaacgttccggttacgttacgttaacgtttattttttacgaggttcggttacccgg

SEQ ID NO: 59540 - DNA, 570 bp, Homo sapiens
  misc_feature: GYAE6OF01EESID.26.57.F02.1.454.CMB.1.raw
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (455)..(455): a, c, t, g, unknown or other
  misc_feature (455)..(455): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtgggaggtccggggggaggcttgggtccgaggccggggggtccctgaaacctctcatgtgcaggctcgtggacttcacattcagtgactcggctatatactgggtccgcagtcgtcggcgggaaggcgtggagtggcttggcgtattacgaaccaacgtgacagtacncganatttangatgcgtgngcgagcgaggtcaccntctcgaganatgacttacgagagaacgacggtacgtatcgtacganaaagtagaacgacgaccgtaagaaaccgaggaccgacggaccgtacggtacttacgtgtcggaccagaccgactccggttacttacgtttacttactttttcgtagtcggtaccg

SEQ ID NO: 59541 - DNA, 981 bp, Homo sapiens
  misc_feature: GYAE6OF01B45AT.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctgggtggaggtccgggggaggcgttggtccgagggcccgggggggtccctagaaactctcatgtgcgaggctcgtggattcactattcagtgaccgtcggacttatacgtacgtcgggtcccgcgtacgttcgtcgggaaccggggaaaagggtcgtgggacggtcgggtaccgtttcgggtacccgtttaagttaaaccggaaaaccctaaaaccgtacggaaacgtaaacggtacggaaccggtaaatttaaacgttttacgtaggccgtttagggccggtttcggggtagaccgggtaaacgggtccggttaaacgggttacccaaccccgttaagttaccccgtaacccggtaaaggtaacggttaaccgtttaagggtaaaccgtttacccggaaagggtaaaaccgggtaaaaccggtaaccccgggggtttaaccgtttaaaccggtttaacccgttaaacggtaaaacccggttaaaaacgttaaaccggttaaaaaccccgggtaaacccgggttaaaccccgggttaaaaaccggggaaaaaaacccccggggtaaccggggtaaaccccgttaacccggggggtaacccgttttagggtttaaaccgttttaaccccggttacgggttaaccgaaccccgggtaaacggttaaacccgtttaaccccggttacccgggtttttaaaccgtttaacccggtttttttaaaccgttttaccggtttttttaaacccggttaaccggggtttcccgggtttaaaccccgg

SEQ ID NO: 59542 - DNA, 767 bp, Homo sapiens
  misc_feature: GYAE6OF01A8P60.26.57.F02.1.454.CMB.1.raw
tcagagactatactcacgaccggtgctcgatttagctcgatatagttgggtttggggctggggagaggagctccagccttggggattcccagctgtctccactcggtgatcggcactgaatacaagagactcaccatggagtttgggctgagcttgggttttccttgttgtcttattttaaaaggtgtccagtgtcaggtgcagctgggtgggaggtccggggggaggtcgttgggtccgagggcccgggggggtccctggaaacctctcctagtgtgcgaggtctcgtggtaattcactattcaggttacacgtcggactaatagtacggtcgggtccgccgacgtcgtacggaccggggaagggtcgtcggggagtcgggtacgttgggtaaccgttaagtaacgaaaacccgtaaacgtacggaacgtaaacggtaccggaactaacgtaaatttagtagtcgttacggcggtcggtagaccgtaaggtccgtaggttaccacccgttaatccccgtaacgagtagaacgttgaacgttaaccgaagaaacggaaaccgtacgggtaacgttacttacgtaagaactaaacgtgtaaaccgacggtaaacccgaaacgggaaacccgtacgggaccgtaacccgggtacggttacgtaacgtttaccgtacgggtacgtacccggaaagaccgttaccgtacggtttaacggtttaacctttaacggttttaacttttccggtaacggttccggttaaacccgg

SEQ ID NO: 59543 - DNA, 679 bp, Homo sapiens
  misc_feature: GYAE6OF01DS9OW.26.57.F02.1.454.CMB.1.raw
  modified_base (125)..(125): a, c, t, g, unknown or other
  misc_feature (125)..(125): n is a, c, g, or t
  modified_base (297)..(297): a, c, t, g, unknown or other
  misc_feature (297)..(297): n is a, c, g, or t
tcagagactatactcacgaccggtgctcgatttagctcgatatagttgggtttggggctgggagaggagctccagccttgggattcccagctgtctccactcggtgatcggcactgaatacaagngactcaccatggagtttgggctgagcttgggttttccttgttgcttagtttaaaaggtgtccagtgtcaggtgcagctggtggacggtccgggggagtcgttcgggtccgacgggtcccggggggtccctaggaaacctcgtcagtgtgcgaggctcgtggtattccacgtnttacagtcgacgtcgcttaatagtacgtcgggtcctccgaggttcgtcggaccggggaagggcgtaggaggtcggtcgtcggtaccgtataaccgaaccaaccgtggaaccgtaagtacgactaacgtaatttagagctggtcggtggtacgacgaacgggtcgtaggttaccaactccgtacgtaaccgaggaacgtacgtagtaacgtacgaaaggaaccgaacggacgtacgtagtcgtaaccgaataagtacgaacgagtaaccgtaacggaaaacggcggaaccgtacggtacgttagtaccgttagtacgtcggaacgtacgcgtaacccgttcgtaacgtttagttaactttaggttttcgagtccggttaaccg

SEQ ID NO: 59544 - DNA, 620 bp, Homo sapiens
  misc_feature: GYAE6OF01ECI8B.26.57.F02.1.454.CMB.1.raw
  modified_base (312)..(312): a, c, t, g, unknown or other
  misc_feature (312)..(312): n is a, c, g, or t
  modified_base (428)..(428): a, c, t, g, unknown or other
  misc_feature (428)..(428): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
tcagagactatactcacgaccggtgctcgatttagctcgatatagttggggtttggggctgggagaggagctccagccttgggattcccagctgtctccactcgtgatcggcactgaatacaagagactcaccatggagtttgggctgagcctgggttttcctgttgcttattttaaaggtgtaccagtgtcaggtgcagctggtggagtccgggggaggcttggtccaggccggggggtccctggaactctcatgtgcaggctctggtacttcactatcagtcgactcggactagtactacgtggggtccncctaaggttcgacgggacccggggaaaggcgtagggagtggcgttaggaccgtaattacgaaacccaaacgtcgaacaagtaccgacgtaacctaatttatgtccgtgcggtggtnacgaagggtcctaggttacaccgactcgaccaagagtatgtactacgagacaaacgcggtactacgtcagacgtaaactgaaacgcgtaaccgtaacggaaaccgaggaccgaccgggtcgttacgtataccgtagccgtacacggatacggtacttacgtacgttaacttnttttacgngttccggtaccg

SEQ ID NO: 59545 - DNA, 923 bp, Homo sapiens
  misc_feature: GYAE6OF01BDLSZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttggggttttccttgttgcttaattttaaaaggtgtccagtgtcgaggtgcagcgtgggtgggaggtccggggggaggtcttgggtccgacgggtcccggggggggtccctaggtaaacctctcagtgtggcgacggctcgtgggtattaccactactttcgaaggtcgtaccgtcggtactaagttacgtaccgttcggggtcccgaccgtacgttaccggtacggggaccgggggtaaacgggccggttaggggtaggttcggggtaccgtttacgggtacccgtttaacgttaaaccgtaaaccccgaaaccgttacggaaactaaacgggtacccggaaccggtaaacgttaaagttttacgtacggtccgtacgggtccgggttcgggtacgtaacggaacgggtacgtaacggttaccccaaccgtaccgtccgttaccaaaggtacgtattacggtacttaacgaaggtaaaccggtaaaccgtaacccgggtacttaaaccggttcgtaacgtaaccgtaaaagtaccgggaaacgtaaccgggtaaacccgtaaacccggggaaaaccgggaaccggggtaaccccgtacccgggggttaacccgttaacgggttttaaccttaacccgggttagtaccccgggaacccgttaaaccggttaaccggttaaccccgtttaccccggggttaacgtttaaaccttttaaccgggtttttaacgttttacccggttaccggggttttaacccgggttaacccccg

SEQ ID NO: 59546 - DNA, 780 bp, Homo sapiens
  misc_feature: GYAE6OF01BRYSN.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacaagagactcaccatggagtttgggctgagctgggttttcctgttgctattttaaaggtgtccagtgtcaggtgcagctggtggagtccggggagcttggtccgaggccgggggggtccctggaaacctctcgatgtgcaggctctggattcacattcagtgactcggctatatactgggtccgcagtctgaccgggaaggctggagtgcttggaccgtattacgaaccaaaccgtgaacgaagtaccgacgtaactaactttagtggccttacgggacgttacggtgaaccggtaagggccgtaacggggtttaccaacccgtactacccgttaacccgtaaggtaacggtacgtacggtaacgtttacgaacggaacggtaaaccgtaaccgggtaccggttaacttcggttaacgtaacgaaaacgttacggtaaaaccgaacgtaccccggttaaagggaaaaaccccggaaccgggggtaaaccgtaaacccggggtcccggtttaaacggttaaaccgtttaaccggttacgggttacccggtaaccccgtaacgggaaccttaaccggttaccccgggttaacgttttaaacccgttttaaccggtttaaacccgtttttttacccggtaagtttcccgggtttaaaccccggg

SEQ ID NO: 59547 - DNA, 679 bp, Homo sapiens
  misc_feature: GYAE6OF01E2RQ9.26.57.F02.1.454.CMB.1.raw
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccggggggaggcgttggtccgagggcccggggggggtccctggaaacctctcatgtgcaggctctggattcacattcagtgactcggctatatactgggtccgcgagtcgtggccggggaaagggcgtgggagtgggcttgggaccgtattacgaacccaaacctgaacaagtacgacgaactaaatttatgacgtggccgttcgggtgacgaagggccgtacggttaccaccctatacccgtaccgaggaagtactagtacttacgaaggaacgaaccgacggtacgtatcctagacaaatagaaccgacgtaccgtaaacggaaacccggagggaccgaccgggtaccgtaggttaaccgttacgtcggtacgacccgtaagaccgtaaccgttaccccgttaccggtttaaacttttaccggtttaaacgttttttccgtaacgggttcccggttaaccccggg

SEQ ID NO: 59548 - DNA, 871 bp, Homo sapiens
  misc_feature: GYAE6OF01DS5U9.26.57.F02.1.454.CMB.1.raw
  modified_base (175)..(175): a, c, t, g, unknown or other
  misc_feature (175)..(175): n is a, c, g, or t
tcagagactatactcacgaccggtgctcgatttagctcgatatagttgggtttggggctgggagaggagctccagccttgggattcccagctgtctccactcggtgatcggcactgaatacaagagactcacatggagtttggctgagcgtggtttctgtagcttatttaaagtntcagtgtcaggtgcagcgtggtggacggtccggggagcgtttcgggccgacggggtcccggggggtccctaggtaaaccttctaccgtagtcggtcggacgaacggtcctcggttacggacttactacgttaattcggaagtacggtacgtaccggtacttacgttacgtaccggttccgggccgtaccgtaaggttccggtaacggaaccggggtaaggcggtcgggaacgttcgggttccgttacgggtaccgttaaacgtaaaccgtaaaacccgtaccgtaacggaaccgtaaacggtacccgtaaaccgttaagtttaaacttacggtccggtacgttccggggttaccggttacggacggtaaccggtaacgggtaccgttaaccgggtacctaaccgttacggttaaccccaccggtaaggtaaacgtacccggtaagtttacgttaacgggaaacggaaacgtaacccggtacggttaacgtacgttagtaaccgtaacgaacgttaacgaaccggtaacccgtaaaccgggtaaccgtaaaaccgggacggtaacccggtaacggttaccggttacgttaaacgttacccgggtagtacccggttacctaacgtaaccgttaccggtaacctttaccgtttaacgttttacgtttaccgtttaacggtaccgttcggttaccccggg

SEQ ID NO: 59549 - DNA, 709 bp, Homo sapiens
  misc_feature: GYAE6OF01BNQHC.26.57.F02.1.454.CMB.1.raw
  modified_base (327)..(327): a, c, t, g, unknown or other
  misc_feature (327)..(327): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcttgttgcttattttaaaaggtgtccagtgtcaggtgcagtcgtgggtggagggtccggggggaggtcgttgggtccgagggccgggggggtcctagaaactctcagtgtgcgaggctcgtggtacttcactattcgagtgtactcggtactatatacgtcggtaccncgtacgtcgtggaccgggaaggcgtgggacgtggtcgttaggccgttaagtaacgaaaccaaactagaacgtaagtacgacgaataagttcgtacgcgtacggcgtggtcgacggaaggtaccgtaggtaccaccgtacgtacccgtacgtaagaaggtattacgtaacttacggaaagtaacgaaaccgtacgtacgttaacgtcgtaacgtaacgtaaagtacgaaacgtaaccgtaccgtaaaccggaaaaccggaccggtaacgccggggtaccttacgtttacgttaacgtcgtacggaacccaggtaccgtacccgttaccggtttaccgttaatttacgttttaacggttttactagggttcccgttaacccggg

SEQ ID NO: 59550 - DNA, 640 bp, Homo sapiens
  misc_feature: GYAE6OF01DXN7P.26.57.F02.1.454.CMB.1.raw
  modified_base (325)..(325): a, c, t, g, unknown or other
  misc_feature (325)..(325): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagcgttgggttttccttgttgcttattttaaaaggtgtccagtgtcaggtgcagctgggtgggacggtccggggggaggcgttggtccgacgggcccgggggggtccctagaaaccgtctcatggtgcgaggctcgtggattcactattcagtgactcggctatatactgggtccncagtcgtggaccgggaaggctggagtggcgttggccgtattacgaaccaacctgaacgaagtacgcgtaactaatttagtgcgtggcgttcgggtcgacgaaggcgtacggttaccacctactctcccgaggacgagtgtagttacgaggaacgaaccgacgggtaccgtactccgtagaactaaagtacgaacgacggaccgtaacgaaaacccggaggaccgaacgggtccgttagtacgttacgtcggtacgacgacgactacgttccgttacgttaacgtttacgttactttttacgcggttcggtacccg

SEQ ID NO: 59551 - DNA, 721 bp, Homo sapiens
  misc_feature: GYAE6OF01CXHA8.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtagtttgggctgagtcgtttgggttttccttggttgtacttaagttttaaaaggtgtccgtagtgtcaggtgctagcgtgggtggacgggtccggggagtcgttcggccgacggggtcccgggggtacctagaacctctcgacgtgtcgagcgtctcgtgtacttcgactattcgagtcgtaccgtcggtacttagtacgtacggtccggtccgacgtacgtccggacgggaaccgggtaacggtcggtagggtacggtcggtcggttacggtacgttaacgtaaacccgaaaccgaaaccgttacggaaccgtaaacgtaccggacgtaatttaaatttgcgtccgtaggtcggtaccggtagaccgacggtctaacgtcccacgtctacgacagtgtatacgtacgtacgaggtaacgacgacgttcgtactgaacgaactaacgtaacgaaccgcgtaaaccggaaacggaacggtacggacggtaccgttaacgttacgtaccgtacgacggtccgaacctacgaccgttacgttaccgttagttaacgtttactttaccggttagtcgttaccgtcgg

SEQ ID NO: 59552 - DNA, 799 bp, Homo sapiens
  misc_feature: GYAE6OF01DEO7J.26.57.F02.1.454.CMB.1.raw
  modified_base (635)..(635): a, c, t, g, unknown or other
  misc_feature (635)..(635): n is a, c, g, or t
tcagagactatactcacgaccggtgctcgatttagctcgatatagttgggtttggggctgggagaggagctccagccttgggattcccagctgtctccactcggtgatcggcactgaatacaagagactcaaccagtgggtagtttgggctggagtccgtttgggtttttcctttgtttgtactttaaagtttttaaaaggtgtccgagtgtcgaggtgcaggcgtgggtgggacgggtccgggggaggtcgttcgggtccgaacggggtcccgggggggttaccctagtaaaccttctctagttcggtgcgaggccttcgtaggtacttaccgactaactttccgaaggttacgtacgttccggtacttattaacggtaccggtttccggggtccccgaccgtacggtccgtaccggggaaccggggtaaacgggtcggtagggtaacggttcgggtcggtttacgggtacccgttaaagttaccgaaaaccgtaacgtacggtaaacgaacggttaacgacgtaaactttaattcgcggtctcgggtcggtacggtccggaacgaaggtcgaacgttacccaccgtacgtctaaccgtagaacgtactagtacgtacgaaggaacgtaaccgnggtacgtacgtactaagaactaaacgacgaaacgttaccgaaccgtaaaccgggaaccgtaacggaccgtaaccgggttccttaagttaccgttcggacgtcgaccgaagtacgtaccgttacgtacgtttactttaaggtttacgtttacgcggttccgtacg

SEQ ID NO: 59553 - DNA, 956 bp, Homo sapiens
  misc_feature: GYAE6OF01EAA57.26.57.F02.1.454.CMB.1.raw
tcagagactatactcacgaccggtgctcgatttagctcgatatagttgggttggggctgggagaggagctccagccttgggattcccagctgtctccactcggtgatcggcactgaatacaagagactcaccagtggtaggtttgggctgagtcgttgggtttttccttgttgtacttaaagtttttaaaaggtgttacctaggttgtacgaggtgacgaggtcgtggggtgggacgggtccggggggtagtccgttcgggtcccggtacggggtccccggggggggttcccctaacggtaaaccgttccgtaccgtaagtcggtacggtccggacggtccgttcgtacggttaagttaccaaacgttacgtttaccgaaggttacgtaccggttccggtacttaacgttaaccgttaccggttcggggtccccgtccggtaacggttccggtacggggaaccccgggggtaaaggggtcgtaggggtacggttcggtacggtttacgggtaccgttaaacgttaaccgaaaaccccgtaaacgtacgaacgtaaacggtcgtaacgtaactttaaagtttcgtacgtcgtggtacggttacggtaggtacgaaaccgggtcgtaaccgttcctaaccgtaacgttccgtacgaagtaacgtagtaacgtacgttaaccgaaggtaaacgtaacccggtaaccgggttaacggttaaccttaccgtacgtaaaacgtaaacgtaaccggaaacccgtaaaccgggtaacccgggtaaaaaccgggaaaacccgggtaaccgggtaaacccggtaccgggtaaccggtttacgtttaaacgttacggtaccggtaaccgtacgtaaacggttacctaaccggtttaacccggttaccgtttaaacggtttttacccgtttaaacgttttttcgggaccggttaccggttaacccggg

SEQ ID NO: 59554 - DNA, 661 bp, Homo sapiens
  misc_feature: GYAE6OF01DY832.26.57.F02.1.454.CMB.1.raw
  modified_base (357)..(357): a, c, t, g, unknown or other
  misc_feature (357)..(357): n is a, c, g, or t
  modified_base (650)..(650): a, c, t, g, unknown or other
  misc_feature (650)..(650): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagcgtgggtggacggtccggggggagtcgttggtcccgagggcccggggggtcctagaaacctctcatgtgcgaggtctcgtggtattcactattcgagtcgactcggcttatagtacgtcgggtccgcgagttcgtcggacggggaaggcgtgggngtggtcgttggtaccgttaagttaacgaaacctaaccgtgaacgaaacgtacgacgaactaaagtttgtcgactcgggtcggtcggtagacgaaggctaaggtccaacctacgtctaccgaagtacgtatagtacgttacgaaggaacgaaccggacggtacgttaacttcgtacgaactaaagtacgaaacaccgtaaccgtaacggaaaaccgacggaccgaccggtacttagtacttagtcgacgaccaagtcctacgttccgttacgttacgtttacttagttttacgngtccgtaccgg

SEQ ID NO: 59555 - DNA, 703 bp, Homo sapiens
  misc_feature: GYAE6OF01D7FZ3.26.57.F02.1.454.CMB.1.raw
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtcagtgtcaggtgcagctggtggagtccgggggagcttggtccaggccggggggtcctgaactctcatgtgcaggctcgtggattcactattcagtnactcggctatatactgggtccnctagtctcggacgggaaagggtctggagtggcttggcgtattacgaacctaaacctgaactaaggtacgacgaataacgtttagcgactgccggttaggngtacaaagggtctaacgggttacacctactctacgaacgagacttgaacttacgaaggtaacgaaccgacggtacgtacgtacgtagtaacgaaagtacgaaaccgacggtaacccgttaaccgggaaaaacccggtacgggaacccggtaacccgggtacccggttaacgggttaaccgttaaccggttcggttaccggtaccgaacggttaaccgaaaccgttttccccggttaacggtttaaccgttttaaaccggtttaacgtttttttaaccggtaaccggtttcggttaaaccccggg

SEQ ID NO: 59556 - DNA, 564 bp, Homo sapiens
  misc_feature: GYAE6OF01DQ3G6.26.57.F02.1.454.CMB.1.raw
  modified_base (183)..(183): a, c, t, g, unknown or other
  misc_feature (183)..(183): n is a, c, g, or t
  modified_base (258)..(258): a, c, t, g, unknown or other
  misc_feature (258)..(258): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (450)..(450): a, c, t, g, unknown or other
  misc_feature (450)..(450): n is a, c, g, or t
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggngtccagtgtcaggtgcagcgtggtggaggtccgggggagcgttggtccacgggccggggggtccctagaaactcncatgtgcaggctcgtgatcacattcgagtgacgtcggacttatatacgtggtccgcaggtcgtggaccgggaaggcgtggagtgtcgtggacctatacgaaccaactgacagtacncgaataattnacgctggcgtggcgagaggcgacggtcactatcacgagagatgtatacagagaacgacggtcgtancgtagacgaaatcgaacacgaccgtaacgaaccgagacgacggaccgttagtagttacgngtcgagacncgtacgttcgttacgttacttacgtttattttcgcgttcgtaccg

SEQ ID NO: 59557 - DNA, 833 bp, Homo sapiens
  misc_feature: GYAE6OF01BN9W6.26.57.F02.1.454.CMB.1.raw
  modified_base (338)..(338): a, c, t, g, unknown or other
  misc_feature (338)..(338): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgacttaagttttaaaaggtgtccagtgtcaggtgcagtcgtggtggaggtccgggggagtcgttcgggtccgacgggtcccggggggtcctagaaactctacagtgtgcacggtctcgtggtactcactattcgagtagacgtcggtactagtacgtaccgtcgggtccncgtagtccgtacgggaccggggtaaacgggcgtaggggacgtcgggtaccggttacggtacccggttaaagttaaccggaaaaccctaaaaccgtcgaaacgttaaacgtaaccggaaccgtaaacgttaaagttttacgtacggtcgttaacgggtcggttaccgggtacgaacggtaacggtaccgtaacggttaccctaacccgacgttcccgtaacggaagtaacgtacgtagttaacgttacgaaagtaacgaaccgtacggggtaacttacgtaccgtaagaaacgtaacgtaaccggaaacgaccggtaaaccgtaaacgggaaaaacccggtaacgggaacccgtaaccggggttaacgtaacgttttacgtacgtacggttaaccgaacccgtaaggttaacccgtaaccggttccggtttaaacggtttaccgtttaacggtttttaaccgtttttacggaacccgggtttccggttaaacccgg

SEQ ID NO: 59558 - DNA, 829 bp, Homo sapiens
  misc_feature: GYAE6OF01EKA09.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggagtttggctgagcttgggttttccttgttgacttaagttttaaaaggtgtccagtgtcaggtgcagcgtgggtggagggtccgggggaggtcgttcggtccgacgggcccggggggtcctaggaaacctctcgagtggtcgcgacggtctcgtggtcttaccgaactacttacgagtcgtaccgtcggtacttaagttacgtacggttcggggtcccgtaccgtacggttccgtaccgggggaccggggggtaaaacggggtccggtaggggtcggttacggggtaccggtttaccggggtacccggtttaaagttaaccggaaaacccctaaaccggtacggaaaccgtaaacgggtaaccgtacgtaacgttaaagttttacgcggtacgtcgggccgggttcggtcggaacggtaacgggtacgtacggttacccgacctacgtaccgtaccgaaggagtactagtaccgttaacgaggtaacgtaaccgacggttacgtactacgtacgtaactaaagacggaaccctacggaacccgtaacggaaaacccgggtacggaaccggttaccggtaccgtttaaggttaccgttagtacggtaccgtacccgaaggtaccgttacgttacccggtttaaccttacggttttaacgttttaccgtttacggtcgttaccgggttaacccg

SEQ ID NO: 59559 - DNA, 653 bp, Homo sapiens
  misc_feature: GYAE6OF01CNDIQ.26.57.F02.1.454.CMB.1.raw
  modified_base (546)..(546): a, c, t, g, unknown or other
  misc_feature (546)..(546): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccgggggggtcctgaaactctcatcgtgcaggctcgtggattcgactattacagtgacgtcggctagtactacgtcgggtaccgccaaggtctggaccgggaaaggcgtggagtggcgtttggccgttattaacggaaccaaaccttcgaacgaagtacggacgtaactaaagtttagtgacttacggcgtttccggggtgacgaaacgggtcgtaacgggtttacccacccgtaacgttccttacccgaaggtaacggtaatacggtatttacgaagaacggaaacgacggacgtaatctacgactaaatacgaanacgacctaacggaaaccgaagtacgacggacgttgtacgttacncggtnaccaggtaccaagttccgttacgttatttaccgttatttttaccgtggtcggtacccg

SEQ ID NO: 59560 - DNA, 853 bp, Homo sapiens
  misc_feature: GYAE6OF01DWUHM.26.57.F02.1.454.CMB.1.raw
  modified_base (556)..(556): a, c, t, g, unknown or other
  misc_feature (556)..(556): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagcgttgggttttccttggttgcttaagttttaaaaggtgtcctaggtgtctaggtgcgagcgtgggtggagggttccgggggagtcgttcggggtacccgaacggggtccccgggggggtacccttagtaaaaccgtcgtaaccgagtggtgaccggaaggggtccttaccggtaggttaaccttaccgtaactaacgtttaccggaaggttacggtaaccgttaccgggtacttaaacgttaacggttaacccggtttccgggggtaccccgtaccgtaacggttccgttacgggaacccgggggtaaaaggtcgtaggggtagttcgggtacttcgggtaaccggttaagttaaccgaaaacccgtaacgtacggaacgtaacgtacggactaactaagtttacgngtacgtcggacgttggtacggacgtaaggcgtaacgtaccgtaacctacgttaccgtactaagtaacgagttagtacgttacgaagtaacggaaacgtaccggagttacgtacgtacggaactaaagtacggaacgtaaccgaaccgaaaccggtaaacggaccggaaccgtaccgggaacgtttaccgttaaacgttacggttacggacgtaaccgtaacgtaaaccgtacccggttaccgtaccggtttaaactttaacggtttaaccgtttttacgacggttcggttaacccgg

SEQ ID NO: 59561 - DNA, 916 bp, Homo sapiens
  misc_feature: GYAE6OF01EEO3F.26.57.F02.1.454.CMB.1.raw
  modified_base (489)..(489): a, c, t, g, unknown or other
  misc_feature (489)..(489): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttggttttccttgttgtcttaattttaaaaggtgtccagtgtcaggtgcagctgggtggacggtccgggggaggtcgttggtccgacgggcccggggggtccctagaaactctcatgtgcgaggctcgtggtattcgaactacttcaggttcgaacgttccggtacttaattaacttaccggttcggggtccccgtccgtaacgggttccgtcggggacccgggggtaaaggggtccgtaggggacggttgggtccgtttcgggacccgtttaagttaacgaaaacccctaaaccgtacggtaacgaaacggtacgaccgtaaactaagttttaacgnggtccgtcgggacggttcgggtacggtaccgtaagggtccgtaacgggtttaccaaccccgtacgttaccccgtacccgaaggtaacggtaacgtttacggtaaacgtttaccggaaacggtaaaccggtaacccggtaaccgggtaccggtttaacgtttaccgtaagggaaacctaaaagtaccggaaaaccgtaccgggtaaaccccggttaaaacgggaaaaaccccgggacgggtaaaccccggtaaccccggggttaccggtttaacggttttaaaccgttaacccggtttacgggtacccgttaacccgggaacgtaacccggttacccggttacccggttttaaccggtttaacgtttttacccggttttttaacggtttttttaaccggtaaccgggtttcccggtttaaaccccggg

SEQ ID NO: 59562 - DNA, 779 bp, Homo sapiens
  misc_feature: GYAE6OF01DJDEQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctgggtggaggtccgggggaggtcgttggtccgacgggcccgggggggtccctagaacctctcatgtgacgaggtctcgtaggtacttacgactatttcgagtcgaccgtcggtacttatacgtaccggtcgggtcccgccgtaggtccgtacgggaccggggaaagggtcgtagggaggtcggtcgttgggtaccgttaagttaacgaaaccctaaacgtcgaaacgaacgggttaaccgacggtaaaccttaaaagttttcgacgtccgttacgggtccgggttacggtacggacggtaacgggtccggtaacggttacccaacccgtacgtaccctacgaacggtagtaacttagtacgttaacgaaacgtaacggaaaccgaccggtaacgttactaccgtacgaacgtaaacgtacggaaaccgtacggaaccgtaaccggaaaaccggtacggaaccgtacgggtacccggttaagttaccttacggtcggtaccaacgtacggaacctaccgttacccgttacgtttaacgtttaacgtttacgtttttacggaggtttccgtaacccgg

SEQ ID NO: 59563 - DNA, 766 bp, Homo sapiens
  misc_feature: GYAE6OF01EG684.26.57.F02.1.454.CMB.1.raw
  modified_base (301)..(301): a, c, t, g, unknown or other
  misc_feature (301)..(301): n is a, c, g, or t
  modified_base (508)..(508): a, c, t, g, unknown or other
  misc_feature (508)..(508): n is a, c, g, or t
  modified_base (548)..(548): a, c, t, g, unknown or other
  misc_feature (548)..(548): n is a, c, g, or t
  modified_base (746)..(746): a, c, t, g, unknown or other
  misc_feature (746)..(746): n is a, c, g, or t
tcagagactatactcacgaccggtgctcgatttagctcgatatagttgggtttgggcgtgggagaggagctccagccgttgggattcccagctgtctccacgtcggtgatcggcactgaatacaagagactcacagtggtagtttggctagagtcgttggttttccttgttacgtacttaagttttaaaggtcgttaccgtagtgtacgtaggtgacgtaggtcgttggtgggtaacgggtccgggggtagtcgttcggtaccggacgggtcccgggggtctacggtaaacgttcgtacgngtcgtagcgtacggtcgtcgtaggtacttctaactgtcgtacgtacgtacgttcgtattacgttacgtacgtcggtcccgtacgtcgtaacggtaccggtaaacgggtaccggtaggtccgtgggtaccgttacggtccggttacgtaaccgttaaacgtaaaccgtaacgtaacgtagtaacgacgttaactagtaacgtagtcgnggtccgtacgtacggacgtagacgaccgttgtaacccgtnaccgtactagtacgtagtagtacgttagaacgtagaacgtaacgtaccgttacgtacgtaagaacgttaaagacgtaaaccgtacgaaaccgtaacgaaacgtaacggtaaaccgccggttaacgtacggtctttacgaccgtagtcgaacgtacccgtaagtacgtttacgtaccgtttaacgtttaccgttttaanccggtttaccgacggttacg

SEQ ID NO: 59564 - DNA, 828 bp, Homo sapiens
  misc_feature: GYAE6OF01BAN1K.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcacatggagtttggctgagtcgttggttttccttgtgtacttaagttttaaaggtgtccagtgtcgaggtgcagcgtgggtggacggtccgggggagtcgttcggccgacgggtcccggggggtccctagtaaaccttcgtcgagtggtcgcgacggtcttcgtaggtacttaccgtaacgtactttacgaaggttcggtaccgtccggtacttaacgttacgttaccggttccggggttcccgaccgttaagggttcccgtacggggaaacccgggggtaaacggggtcgttaggggtaacgggttcggtaccggtttaccgggtaacccgttaaagtttaaacccgaaaaccccgtaaaccgttaacgaaacgtaaaccggtaaccgtaccggtaaaactttaaagttttacgcgttacccggtggtacccgggtacggtacgaccggtaacggtcgtaacggttacccgaacccttactcccgtaaccgaagtacgtagttacgtacgttacgaaaggtaaccgaacgtaccggtacggttacttcgtagaaactagaacaacggactaccgtaaacggaacgtaccggacgaccggtacgtagttacgtacggtacgaccgtacgaacgtaccgtaccgttaccgttaacgttatttaccgtttacgtttttagacccggttttcggtaacccgg

SEQ ID NO: 59565 - DNA, 739 bp, Homo sapiens
  misc_feature: GYAE6OF01APETQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttggttttccttgttgtacttaattttaaaaggtgtctagtgtcgaggtgcagcgtggtgggaggtccgggggagtcgttcggtccgagggcccggggggtccctaggaaacctcgtacatggtgcgaggtctcgtggtaacttcacgtattcgagtgactcggacttaatacgtacgtcgggtccgaccgtaaggtcgtacgggaaccggggaaaacgggtcgtaggggtacgtcgggtcgttacgggtaccgttaaacgttaaacggaaaaccctaaaccgtaaggaaacaaacggttaaccgaacgtaaacttaaaagttttagcggtacgttacgggtccggttacgggtacgtaacgaacgggtaccgtaacggttacccaacctaacgtcctaccggaagtaagtactagtaactacgaaagaacgaaccgacggtactactacgaacgtaacgaagtaacgaacgacgtacccgaaacggtaaaccgacggacgaaccggtctagttacgtaacgtcggtaacaccgtaagcctacggttacccgtagttaacgttacgtttatttcgacgttccgtacg

SEQ ID NO: 59566 - DNA, 711 bp, Homo sapiens
  misc_feature: GYAE6OF01AOTXM.26.57.F02.1.454.CMB.1.raw
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
  modified_base (415)..(415): a, c, t, g, unknown or other
  misc_feature (415)..(415): n is a, c, g, or t
tcagagactatactcacgaccggtgctcgatttagctcgatatagttgggtttggggctgggagaggagctccagccttgggattcccagctgtctccactcggtgactcggcactgaatacaagagactcaccatggagttgggctgagctgggtttcctgttgctatttaaaaggtgtccagtgtcaggtgcngctggtggagtccgggggagcttggtccaggccgggggggtaccctgaaacgtctcagtcgtgcaggctctggattcacnttcagtgactcggctatactacgtcgggtccgccagtctcgggacccggggaaagggccgttgggagttgggcgttagggcccgtaagtttacggaaaaccctaaaccgtggaacaaacggtacgacgtaacaattttangtctacgtcggtccggtgacgtaaagggccgtacggttccaaccgacttaccgtacccgaagtaacggtaacgtacggtaactttaccgggaagaaacggaaaaccggtaaccggggtaccggttaacttaccgtaccggtaactaaaacgttaacggaaaaccgtacgaacccgttaaaccggaaaaccggtaacgggaaccgaaccgggtaccgttacggttacttaacgtcgtcgacctaggaccgtacgtcgttacgttaacttacgttattttacgagttccgttaaccgg

SEQ ID NO: 59567 - DNA, 784 bp, Homo sapiens
  misc_feature: GYAE6OF01C1JD2.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggtttccttgttgctattttaaaggtgtccagtgtcaggtgcagctggtggaggtccgggggagcttggtccgaggcccggggggtccctagaaactctcagtgtgcgaggtctcgtggacttcacattcagtgactcgctatactacgtcgggtacccgcgtagtcgtacgggacccggggaaagggtccgtgggtaggtacgggtcgtttacggggacccgttaacgtttaaaccggaaacccgtaaaacccgttggaaaacccgtaaacgggttaaacccgaaccggtaaaccgttaaaagtttttacgacggtccgttcgggtccggtaccgggttgaaccggtacgggtaccgtaacgggttaccctaaccgtaaccgttaccgtacccgaacggtaacgtaagttacggtacgttacggaaagaaccgggaaaacccggtaccggtacgttacgttaccgtaagtaactaaaagtacggtaaaccaacggtaccgtaaggaaaacccggaacgggtaccgaaccggtcgttaacggtacttaccggtacgacgaccgaacggaacttccggtaccgttcggttaaactttaaccgtttacgttttacgtgttaccggttacccg

SEQ ID NO: 59568 - DNA, 861 bp, Homo sapiens
  misc_feature: GYAE6OF01CUY0N.26.57.F02.1.454.CMB.1.raw
  modified_base (318)..(318): a, c, t, g, unknown or other
  misc_feature (318)..(318): n is a, c, g, or t
  modified_base (451)..(451): a, c, t, g, unknown or other
  misc_feature (451)..(451): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagcgttgggttttccttgttgtcttaattttaaaaggtgtccagtgtcaggtgcagctgggtggaggtccggggggagtcgttggtccgagggcccgggggggtccctggaaactctcgtatgtgcgaggtctcgtggtattcaactattcagtgaccgtcggctaatntaaccgtcgggtccaccgtacggtcgtcgggaccggggaaagggtcgtgggaggtggtccgttagggtaccgttaagttaacggaaacccaaaccgtgaaacgtaaacggtacgaccgtaataaattttaagngtaccgtggtccggttcgggtcgacgtaacgggtcgtaacgggttaccaaccgtactacccgttaacccggaagtaacgtaagttacgtaacgttacgaaaggtaaccggtaaaccgtaaccgggttacgttaacgttaccgtaacggtaacgtaaaacgtacggaaaaccgtaaaccggtaacccgttaaaccgggaaaaaccccgggtaaccggtaaccgggtaaacccgggggttaacccggttaacggtttaaaaccgtttaaaccggttccgggttaacccggtaaccccggtaaacggtaaaccccgttaacgttaacccccgggtttaaacgttttaaacgttttttaaccggttttaaactttttttccgggttaaaccggtttccccggggttaaacccgg

SEQ ID NO: 59569 - DNA, 737 bp, Homo sapiens
  misc_feature: GYAE6OF01CUTDZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagcgtgggtgggaggtccgggggaggtcgttcgggtccgacgggtcccgggggggtccctaggaaacctctacagtggtgacgaggtctcgtggacttcactattcagtgactcggactatatacgtcgggtccgccgagtcgtacggaccgggaaaggcgtgggagtggtcgttggccgttaagtaacgaaccaaaccgtgaaccgaagtacgacgtaactaatttagcgtcgtggtacggtcggtacgacggaaacgggtccgtaacgggtttacccaaccgtacgtaccgtaccgaaggtacgtagtacgtaacgttacgaaaggaacgaaacccgtacgggtacgtaacttacgtacgaacgtaaacgtaacggaaacgaccggtaaccgtaaacgggaaaacccgaacgggtaaccgaaccgggttaccgttacggttacgttaccgtacggtaccgaccgtaaacgtccgtaaccgttccggttacgttaacgttttacgtttacgtttttacgtacggttccggtacccgg

SEQ ID NO: 59570 - DNA, 759 bp, Homo sapiens
  misc_feature: GYAE6OF01C9P2X.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgcttaattttaaaaggtgtccagtgtcgaggtgcagcgtgggtggaggtccggggggaggtcgttcgggtcccgacgggcccgggggggtcccctaggaaaccttctcagtgtgacgaggtctactgggtacttcaaccagtttcaacgttgacctcggacttatagtaccgtggggtccccgccagtccgtcggaccggggaaagggctgggagtcgggcgttggtaccgtattaacgaacctaaaccgtgaacgaaacgttcgacgaactaaatttagcgtcgtacggtcgttcggacgccggaaagggtccgtaaggttaccaacccgtctccgttaccgagtacgtagtagtacgttacaaacgaacggaaaccgacgggtacctacggtaccgtacgaacgtaaaacgtacgaaaccgacttaacccggaaacgggaaaaccccggaacgggaacccgtaacccggggaccgtttaggtaaaccgtttaccgtaggtaccggacccgtaacggtaactaccgttacccgtttaacgttaacggttttaccgtttaatttttcggtaccggttccggttaccccgg

SEQ ID NO: 59571 - DNA, 886 bp, Homo sapiens
  misc_feature: GYAE6OF01DI5UY.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtagtttgggctgagtcgttgggttttccttgttgtactttaaagttttaaaaggtcgtacctagttgtacagggttgcaggtcgtgggtgggacgggtccggggggagtcggttcgggaccggtacgggggcccggggggtccctaaggtaaccttctctagtggtggacgtggtctgtcggtacttcacttattcgagttcgtacgtcgtacgttaactacgttaccggttccgggtaccgtaccgtaagggttccggtaaccgggggaacccgggggtaacgggttcgggtacgggtagggttcggtaccgtttaccggggtaaccgttaagttaaacccgaaacccaaaccgtacggaaacgtaaacggtacgaaccgttaactttaagttacgtagtcggtccgtcgggttacggtaacgaccggtaacgggtacgttaaccggttacccacctaaccgttacccgaacgtacggtaattacggtacggtttaacgaaccggtaggaaaccggtaacccggtacgggtaccgttacgtacgtaaccggttaaactaacggtaaccgtaaaccgtacgttaaccggaaaaccggtaaacccgaacgggtccgtaaaccggtacgttaacggttaccgtaggttaaccgaccggtacccggtaacgttaccgtaccggtttaccctttaacgtttaaacggttttaccgttttaacggttttacgtccggtttcccggtaacccgg

SEQ ID NO: 59572 - DNA, 861 bp, Homo sapiens
  misc_feature: GYAE6OF01CFSV3.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctggtggaggtccgggggaggtcgttggtccgacgggcccgggggggtccctaggaaactctcagtgtgcgaggctcgtggattcactattcgagtcgactcggacttatattaccgtggggtacccgccgtacggttcgtcgggaacccgggggaaaggggtccgttaggggaggttcgggtccgttcggggtaccgttaagtttaacggaaaccctaaaaccgtgaaaccgtaaaggtaccggaccgtaactaaacgttttacgtacggtccgtcggtaccgggttacggtacgaaccggtaacgggtccgtaacgggtttacccaacccgtacgttaccccgtacccgaaggtaacgtagttaggtaacgtttaccgaaggtaaaccggtaaacccggacgggttaccgttaacttaccggttacgaaacgtaaaacgttaaccggaaccgtaaccgggtacccgttaaaaccgggaaaaccccgggtagggaaccccggtaaccggggtacccgtttaacggttaacgtttaaccggttaggtacccgtaaccggtaaccgtacccgttaccggtttaccccgggttaacggttttaaccgtttaaaccggtttttactttttacccgggttaagggttcccggtttaaccccggg

SEQ ID NO: 59573 - DNA, 930 bp, Homo sapiens
  misc_feature: GYAE6OF01CZH1X.26.57.F02.1.454.CMB.1.raw
  modified_base (242)..(242): a, c, t, g, unknown or other
  misc_feature (242)..(242): n is a, c, g, or t
  modified_base (916)..(916): a, c, t, g, unknown or other
  misc_feature (916)..(916): n is a, c, g, or t
tcagagactatactcacgaccggtgctcgatttagctcgatatagttgggtttggggctgggagaggagctccagccttgggattcccagctgtcctccactcggtgatcggcactagaatacaagagactcacagtggtagtttggctgagtcgtttggttttccttgttacgtactttaagttttaaaacggtgtcctagtgtacgaggtgacgtagcgtgggtaggacgggtccggggngttcgttcggccggaccggggtcccgggggtaccctaaggtaacctccgtacgagttggtcgacgacggtccttcgtaaggtaccttaccgtataacgttacgtaggttcgtaacgttccggtacttaacgttacggttaccggttccgggtaccccgtaccggttaacggtcccgggtaaccggggtaacccgggggaaacggttcgggtttacggggtaccgggttcggttacccgggttttaaccgggaacccggtttttaaaacgtaaacccggaaaaacccgttaaacccggtaaggaaaaccggttaaaccgtaaccggtaaacgttaaatttaaacgtttttgaccgggtttaccgttaccggggtcggggtttaacggtacggaaacccgtacgggttaccgtaacgtttaaccccaccgttaccgtaccgttacgaaggttaacgtaacgttacgtaaggttaacccgaaggaacccgttaaacgtaccggttaaccgtataccggtaacgaacttaaaccggaaccgtaacggaccggtaaaccgaaaccgggaaaccggtaaccggtaccgtaaccgggttacgttaccggtacttacgggtacgaccgtaagacccgttatacccgttaccgtttagttaacctttacgtttatttaacggnggttcccttacggg

SEQ ID NO: 59574 - DNA, 729 bp, Homo sapiens
  misc_feature: GYAE6OF01BQZWW.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacaagagactcaccatggtagtttggctgagtcgttgggtttttcctttggttgtctttaagtttttaaaaaggtgtccgtagtgtcgaggtgcagcgtgggtcgggagggtccgggggaggtcgttcggtccgacggggcccgggggtcctagaacctctcagtgtgcgaggctcgtggtattacactattcgtagtcgtacgtcggtactagtacgtaccgtcgggtcccgccgtacgtcgacgggaccgggaacggcggtggtaggtcggtcgttacgtaccgttaacgtaacgaaacccaaacgtcgaacgaacgtacgacgtaacttaagtttatcgtcgtcggtcgtccggtagaacgtacggtacgtacggttaccaccgtacttacccgacgtaagtacgtatacgtaagttacgaagtaacgaaccgtacggtacgtgtacgtacgaactaacgtaagaaccgtacgtaaccgtaaacggaaaccggtccgaacggttaccggtacgttagttaccgttacgcgtaccgacaacggttacctaccggtttaccggttaacgtttaactttacgttttagttttccgaacggttacgttaccg

SEQ ID NO: 59575 - DNA, 886 bp, Homo sapiens
  misc_feature: GYAE6OF01C8XG4.26.57.F02.1.454.CMB.1.raw
tcagagactatactcacgaccggtgctcgatttagctcgatatagttgggtttggggctgggagaggagctccagccttgggattccccagctgtctccactcggtgatcggcactgaatacaagagactcaccatgggagtttgggctgagcttgggttttccttgttgcttaattttaaaggtgtccagtgtcaggtgcagctgggtggaggtccgggggaggtcgttgggtcccgacgggccccggggggggttcccctaggaaaaccgttcctaccgtagttcggtcggccgtacgggtccttccgttaggggtaacttttccaaacctagtttaccgtaagggttacggaaccttccgggaaccttaagttaacgttacccggttcgggggtaccccgacccgtaacgggttcccgttagggaaccccggggggtaaaaggggtcccgttagggggaaggttcggggtacccgtttcggggacccgtttaaagtttaaacccgaaaacccgtaaacccgttggaaaccgtaaacggttaacccggaaccgtaaacccgttaaaatttttcgaacggtccgtacgggtcggtaccggggttagacccgggtaaagggtccgtaacgggttaccgtaacccgtaacttacccgtaaccctaacggtaactaacgttaagtaccgttacgtacggaacgaaaccgtacgggtacgtaacgtccgtacgaactaaagtacgaacgaacgtaccgtaacgaaaacccggtacggaaccgtacggtaccggttagtacgttacctagggtactaccgtaacggtaacctaccgttaccgtacggtttaacgtttaacgtttagttttttaccgcgttcggtaacccg

SEQ ID NO: 59576 - DNA, 804 bp, Homo sapiens
  misc_feature: GYAE6OF01BR1NE.26.57.F02.1.454.CMB.1.raw
  modified_base (124)..(124): a, c, t, g, unknown or other
  misc_feature (124)..(124): n is a, c, g, or t
tcagagactatactcacgaccggtgctcgatttagctcgatatagttgggtttggggctgggagaggagctccagccttgggattcccagctgtctccactcggtgatcgcactgaatacaagngactcaccatcggagttggctgagctggtttcctgttgctatttaaagtgtcagtgtcaggtgcagctggtggagtccggggagctggtcaggccgggggtcctgaaaccgtcctactagtgtgcgaggctcgtggattcacgacttcgagtcgtaccgtcggtacttaagtacgttaacgtcgggtaccgacccgtaacggttccgttacgggacccggggtaaaacggggtcccgtagggtaacgtcgggtaccgttcgggtacccggttaacgtttaaacggaaacccgtaaaaccgtggtaaaccgtaaacgggtaacccgtacggaactaaacgttttaacgtacggtaccgttaccgggccgttaccgggttaccgacgtaacgggtccgtaacggttcccgtaacgtacgttcccgtacggtaaaccgtaaggtaccgtagtaacgttagtaacggtaagaaccggtaccgtacgtaagtttaccgacgtaacgtaaacgtaacgaaccgtaaccgtacccgttaaacgggaaaccggtaagggtaacccgaccggtaaccggttaggttaccgttaaacgtacggtaccgaccggtaacgaccgtaaaccttccggttaaccgtttaacgttaccgtttaacgttttttacgaacgtttcccgggttaaccg

SEQ ID NO: 59577 - DNA, 691 bp, Homo sapiens
  misc_feature: GYAE6OF01DZ376.26.57.F02.1.454.CMB.1.raw
  modified_base (214)..(214): a, c, t, g, unknown or other
  misc_feature (214)..(214): n is a, c, g, or t
  modified_base (507)..(507): a, c, t, g, unknown or other
  misc_feature (507)..(507): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgacttaagttttaaaaggtgtccagtgtcaggtgcagcgtggtggnggtccgggggagtcgttggtccgacgggccgggggtccctagaaactcgtcagtgtgcgaggctgtaggattcacgtacttcgagtcgactcggtacttagtactacggtcgggtcccgccgtacggtccgtcgggaccggggaaggggcgtgggaggtcggtcgttacgggtaccgttaagtaaccgaaaccgtaaaccgtagaacgtaaacggtacgacgtaactaacttagtcgacgtcggtacgtcggtagacgtaggacgtacggttccaaccgtctactacgaaganatagtatacgaagtaacgacgacgtacttagcgtaagaacaagtacgaagacgaaccgttaaacgaaaccggacgaaaccgtccgggtacttaggttaccttaacgtcgtaccgacgtaacgccgttacgtcccgttaagtttaactttacgttttaagtttcccggtggtcccgttaacccgg

SEQ ID NO: 59578 - DNA, 822 bp, Homo sapiens
  misc_feature: GYAE6OF01CGCOQ.26.57.F02.1.454.CMB.1.raw
  modified_base (442)..(442): a, c, t, g, unknown or other
  misc_feature (442)..(442): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggtagtttgggctgagtctgggttttccttgttgcttaattttaaaaggtgtccagtgtcaggtgcagctggtggaggtccgggggagcgtggtccgaggccgggggtcctggaactctcgatgtcgcaggtctctggacttcactattcagttgactcggacttatagttaccgtcgggtccgcgtacgtctacgggacgggaaaggcgtagggagttcggtcgttcgggtaccgttaacgttaaccgtaaacccgtaaacgttcgaaacctaacggtaccgtaccggtaaactaacgttttacgnggtaccgttcgggtacggttcggggtagaacccggtaacgggtaccgttaacgggttcccgtaaccgtaaccgttaccccgttaaccggaggttaaccgaagttacggtaacgttaacgaaacggaaaggtaaacccggacggttaaccgtaagttaccggtaacgaacgtaaattaaccggaacgtaccggtaacccgtaaaacggaaaacccgggtaacgtaaaccgggtaacccgggtacgtttaccggttaaacttacggttacggtaaccgtaccgtaacggttacccgaaccgttttaaccccggtttacgtttaaacggtttttaacccggtttaacgttttttccgtaaacggggtttcccgttaccccggg

SEQ ID NO: 59579 - DNA, 849 bp, Homo sapiens
  misc_feature: GYAE6OF01D9LI3.26.57.F02.1.454.CMB.1.raw
tcagagactatactcacgaccggtgctcgatttagctcgatatagttgggtttggggctgggagaggagctccagccttgggattcccagcctgtctccactcggtgatcggcactgaatacaagagactcaccatggagtttggctgagctgggttttcctgttgctattttaaaagtgtccagtgtcaggtgcagctggtggaggtccgggggaggtcttggtccgacgggcccggggggtccctggtaaactcctcatcggtgcaggctcgtggtacttcactattacaggtcgtaccgtccggtactaattacgtaccggttccggggtacccgtcccgtaacggttccggtacggggacccgggggaaaaggggtccggtacggggtagggttcgggtccgttacggggtacccgttaacgtttaacggaaaaccccgtaaaccgtacggtaaaccgtaaacgggtaccgaaccggtaacttaaacgtttaacgtacgtcgtacgggtaccgggttcggtaggtaccggaacgggtaccgtaacgggttacccctaacccgttaacgtccccgtaacccggaaggtacgtacgttacgtaacgttaacgaacggtaaccggaaccgtaaccggtaccgttacgttaccgtaacgaacgtaaagtaggtaaacccgtacggtaacccgtaaaccggaaaaccgggacgggtaacccggtaaccgggtaacccgttaggttaccgttacgtcggtaccgaccgtaacggtacgtacccgttaacccggttacgtttacgttttaaccgtttagtttttaaccggtggtttacccggttaacccggg

SEQ ID NO: 59580 - DNA, 801 bp, Homo sapiens
  misc_feature: GYAE6OF01CU7TU.26.57.F02.1.454.CMB.1.raw
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttgggctgagcgtggtttctgttgctatttaaagtgcagtntcngtgcngctggtggacggtccggggagtcgttggccgacgggtccggggggtaccctaggtaacctcgacgtagtcggtgacgcggtcctagttcggtattccaactattcgtaacggtacggtacctcgggtacttattaccggttaccggttcgggtacccctaccgtaacgttccggcggggtaaacccggggtaaaggtccggtagggtacggttccggttcggttaacgggtcccggtttaaaacgttaacccggaaaaacccgttaaacccgaggtaaaccgtaaacgtttaccggaaacgtaaactttaatttaacgttggtacgtcggtaaccggttcggaaggtaaccgaaggtccgttaacggtaacctaccctacgtacctacgaaagtataaggtactaccgttacgaaggtaaccgtaaccgtacggtacgttactaccgtaagtactaaacgtacgaacctaacgtaccgaaccgggaaaaccgaccggtaaccgtcggtaccgttaacgttacgttaccgttacggaccgtacgacggtaaccgttaccgttccgttagtttaaacgtttacgtttactttaacggttgtacccgttaacgggg

SEQ ID NO: 59581 - DNA, 756 bp, Homo sapiens
  misc_feature: GYAE6OF01CLUE0.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggtttccttgttgtcttagttttaaaggtgtccagtgtcaggtgcagcgtggtgggacggtccggggggaggtcgttggtccgacgggcccgggggggtccctagaactcctcagtgtggacgaggtcctgtggtattcacctattcgagtcgactcggtactagtacgtacggtcgggtcccgaccgtacgtccgtacgggaaccggggaacgggcggttgggacggttcgggtccgttcgggtaacccgttaagttaaccggaaaacccaaaccggtacggaaaccgaaacgttaccggaaccgtaaacttaaacgtttcggagtccgtacgggtacggttccgggtagaccgaaagggtcttaaccgggttccaacccgtacgttacctacccgaaaggtacgtaagtacgtacgttacgaagtaacgaaccgacgggtacgtaactcgtacgaactaagtaacgaacgtacgtaccgaaacgaacggaacggtaccgaccgggtccttaagtaccttacggtagtccgacgtaacggtcctcgttaaccgttacggtttaacttacccgtttaattttcgggacgttcggtaacccgg

SEQ ID NO: 59582 - DNA, 827 bp, Homo sapiens
  misc_feature: GYAE6OF01CE4I6.26.57.F02.1.454.CMB.1.raw
tcagagactatactcacgaccggtgctcgatttagctcgatatagttgggtttggggctgggagaggagctccagccttgggattcccagctgtctccactcggtgatcggcactagaatacaagagactcaccagtggagtttggctgagtcgttggttttcctgttgtcttaagtttaaaggtgtaccagtcgtcgaggtgcaggcgtagggtgggacggtccgggggagtcgttcggccgacgggtcccgggggtcctaggtaactctcgagtgtcgacgcggctcgtggtacttcacgtcttcgagtcgtacgtcggtatatacgttacggtcgggtaccctacgtacgtccggtaacggggacccggggtaaggtccgtttagggacggtggttccgttaggtaccgttaaacgtaaaccgtaaaccgtaaacgttacgaaacgtaaacggacgtaacgtaaacttaagtttcgtaacggtccggtacggttccggacggttaccggaacggtaaccgggtacgttaaccggttaacccgaacgttaacccgttaccgtaccggaaaacggtattacgtaaacggtttacgaacgtaaacggaacggtaaccggtaccgggtactacggtaactacgaaacgtaacgtacgaaaccggtaccgaaacggtaaaccggtaaaccgggtacgacccgtacggtaccgtttagtaaccgtttagaacccgtccggtaagaacggtacccgtttaacgttacccggttacgttttaaacgtttcccgttttaacggttttacggtcccggttaacggtaacccggg

SEQ ID NO: 59583 - DNA, 690 bp, Homo sapiens
  misc_feature: GYAE6OF01EKO6N.26.57.F02.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (445)..(445): a, c, t, g, unknown or other
  misc_feature (445)..(445): n is a, c, g, or t
  modified_base (536)..(536): a, c, t, g, unknown or other
  misc_feature (536)..(536): n is a, c, g, or t
  modified_base (546)..(546): a, c, t, g, unknown or other
  misc_feature (546)..(546): n is a, c, g, or t
  modified_base (666)..(666): a, c, t, g, unknown or other
  misc_feature (666)..(666): n is a, c, g, or t
tcagagactatactcacgaccggtgctcgatttagctcgatatagttgggtttggggctgggagaggagctccagccttgggattcccagctgtctccactcggtgatcggcactgaatacaagacgactcaccatgggtagtttgggctgagtcgttgggttttccttgttgtacttaatttaaaggtgtccagtgtcgaggtncgngtcgtggtgggacggtccgggggagtcgttcggccgacgggtcccgggggtcctaggtaacctctctagtgtgcgtacggtctgtggtactcgtactntacgaggtacgtacgtcgtactatacgtaccggtccggtccgcgtcggttcggacggggtacgggagggtcggtggtggtcggtcgttcggtaaccgtaataaccggaaaccacgtagacgaacgtacgactatagttncgtcgtcgtacggtggacgacgtacggtcgtacgacctacctacgtcgtacgaagtagtagtagttaccgagtaacggacgtagtaccgtntaacgtcaanaacgtacgagaacgacgtaaccgaacggaaccgtcggtaacctacggtattacggtaccgttgtaccgacttacccgggaattccggtaaccttacgtttacgttaactttacggttttntaaccggtttccggaagttccggg

SEQ ID NO: 59584 - DNA, 784 bp, Homo sapiens
  misc_feature: GYAE6OF01B05HJ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggagtttgggctgagtcgttgggttttccttggttgtacttaagttttaaaaaggtgtaccgtaggtgttcgaggtgcgagtcgtgggtgggaggtccggggggaggtcgttgggtccgaacgggtccgggggggtccctaggtaaactcctgagtgtgcgaggtctcgtaggtattcactattacgagttcgaactcggtatatacgttacggttcggccgtccgagttccgtacggacccggggtaagggcggtagggtaggtccgggtcgttaccgggtacgttaaacgtttaaaccggaaaaccgtaaaccgtaacggtaaaccgtaaaacggttaacccgggaaacttaaaccgttaaagttttacggtacgttaccggtacgggtccggttacggtacggacggtaacgggcgttacggtacctaccgtactccgtaacgacgtaagtagtagtagttaacgaacgtaacggaaaccggacggtacgtacgtacgtacgaacttaacgaacgaacgaacgtaaccgtaaacgaaaccgggaacgacggaccggtacgttacgtacgttacgtgtaccgacgaacgtacgtaccgttcgttacgttaacttacgtttagtttacgtacggttcggttacccgg

SEQ ID NO: 59585 - DNA, 805 bp, Homo sapiens
  misc_feature: GYAE6OF01DBEV7.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtaggtttgggctggagtcgttcgggttttccttggttgtacgtttaagttttaaaaaggtcgtaccgaggttgtacgtaggtcgacgagtcgttgggtagggacgggtccgggggaggtcgttcggaccggacggggtcccggggggtaccctaggtaaacctcgtctagtgtcgacgcggtcgtcgtaggtactcatacgttcgaagtcgacgtacgtattagtacgtacggtcgggtaccctcgtacgtccgtacgggacgggtaaggcgtaggtacgtggtacgttacgggtacttaacgtaacgaaaaccgtaaccgtacggaaacgtaaacggtacgaaccgtaaacttaagtttcgcgtacgtcggtacggttcgacggtaacgtacgggtcgttaaccggtacctacgtacgtcgaaccgaggtaccgtaagtcgtaaacgtacggaaacgtaaccggaaaccgacgggttattaaccggtacgaacgtaaaacgtacggaaacgaaacccgtaacggtaaaccggaaaaacccggaaaccggaacggacgggtacccgtagttaacgttaaccgtgtaacggaccgtaccggtaatacccgtacgttacgttaacgtttaacgtttacgtttagttacggtaacgtccggttaacccgg

SEQ ID NO: 59586 - DNA, 893 bp, Homo sapiens
  misc_feature: GYAE6OF01C94HC.26.57.F02.1.454.CMB.1.raw
  modified_base (131)..(131): a, c, t, g, unknown or other
  misc_feature (131)..(131): n is a, c, g, or t
  modified_base (206)..(206): a, c, t, g, unknown or other
  misc_feature (206)..(206): n is a, c, g, or t
tcagagactatactcacgaccggtgctcgatttagctcgatataggttgggtttggggctgggagaggagctccagccttgggacttcccagctgtctccacgtcggtgagtcggcactagaatacaaganactcaccagtggtagtttggctgagtcgttggttttctgttgtcttaagttttaaaggtgtccagtgtcgaggtnacgagtcgtaggggtgggaggggtccgggggaggtcgttcggaccggacggggtcccggggggtaccctaggaacctcgtacagtggtgacgtacggtcgttcgtacggtacttacacttaagttccgaaggtcaccggttcggacttaagttacgtaccggttcgggtacccgtcgtacggttcggtaaccgggaaccgggggtaagggtcggtcgggtaagggttcggtcgggtttaccgggacccgttaaactaaccggaaaccctaacgtaggtaaccgtaaacgtaccgtacgtaactttaagtttacgcgtcggttacggtacgggttccggaaggaccgacggttaccgtaccggttaaccctacgaccgttaccgaaaccggtaggtaactacgttaacggttacgaacgtaacggtaaacggaaacccggttacgggttaccttaaggtaaccggtaaacgaaaccctttaaagggccctaaaaacccgggtaaccgggttacccaaaaaccggggaaaccggtaacccggtccggggtaaacccgttacggttcgtttaaaccgggtacctcgggttaaacccgaccgttaacgtaacccggtttcccgtaaacgtttaccgtttaaaggttttacccgttttacgtttacccggtaccgggttcgttaacccccgg

SEQ ID NO: 59587 - DNA, 713 bp, Homo sapiens
  misc_feature: GYAE6OF01B2ETP.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagtcgttgggttttccttgttgtcttaagttttaaaaggtcgtaccagtgtcgaggtgcagcgtgggtggacggtccgggggagtcgttggtccgacgggtcccgggggtcctagaaactctcagtgtcgcgaggtctgtgtacgttacactattcgagtcgtacgtcggtacttagtaacgtaccggtcgggtcccgcgtaacgttccggtacgggaaccggggtaaaggtcggtagggtacggtcggtcgttacggtacgttaagttaaccgaaacccgtaaccgagaaacgaacgtacgacgtaacgttaattcgtcgtcgtacggtcggtacggtacgaacggtaaggtccgtacgtaccgacctacgtacctacgaagagtacgtgtaactacgaagaacgaacgtacggtacgtactacgtacgaactaacgtaacgaacgtaacgaccgtaaacgaaaccggtacggaccgtaccggtacgtacgttacgtagtacgccgtaacacgtactccgttacgttacgttacgttacgtttacttttcgcgttccgtacgg

SEQ ID NO: 59588 - DNA, 733 bp, Homo sapiens
  misc_feature: GYAE6OF01CKLDD.26.57.F02.1.454.CMB.1.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtgctatttaaagtgtcagtgtcaggtgacagctggtggagtccgggggagcttggtaccaggccggggggtccctgaaactctcatgcgcnggctcgnggtatacacnttcagtcgactcggactatatacgtggtccgacctagtcgcggaccggggaaaggtccgttagggacgtgggtcgttaggcccggttaattaacggaacctaaacctgaacgaacgtacgaccgtaactaaagtttaacgtgtcgtcgtcggtacggtacgtacgaacgggttaccgtacggttaccgaaccgtacctacctacccgaagaaccggtacttaagtcgttacgaaacggtaacggtaaacgaacgggtacccttaaagtccgttacggaacgtaaaacgtagtaaacccgaacggtaacccgttaacgaaaaacccggacggtaaccgaccgggtaaccgtaacggttaacgttacggtttaaccggtcgaaaccgacggtaaccgtaccgttccggttaaaccgttacgttttaaccgtttagtttttaccggtaccgtcggtttaaccccgg

SEQ ID NO: 59589 - DNA, 932 bp, Homo sapiens
  misc_feature: GYAE6OF01A2IAU.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatgggtagtttgggctgagtcgttgggtttttccttgttgtctttaagtttttaaaaaggttgttccgtaggttcggttacgagggtgccgaggtcgttggggtggggacggggtcccgggggggtagggtcgtttcgggtccggtaccgggggtcccgggggggggttacccttaggtaaaccttcgtacgtagtggtcggcgtacgggtcgttccgttggtacttcaaccttagttacgtaggttacgtaccgttcggtacttaagttacgttaccggtcggggtcccgaccgttaacggttccggtacggggaaccgggggtaaacggggtccggttagggggtaggttcgggtcgttacgggtaccggtttaaacgttaaccggaaaccctaaaccggtagtaaacgtaacggtacccgacgtaaactaaagtttacgtcgtccgtcgggtcggttacgggacggtaaccgaacgggtaccggtacgggtttaacccaacccgttacgttaccgtaccgtaaaggtacggttaattacggtaacgtttaaccggaacgggtaaacgggaaacccggtaacgggttaccgttaacggttacgtaacggtaaaccgtaaacggttaaccgaaaccgtaaccggtaaacccggtaaaccgggaaaacccggacgggtaaccggtaccgggttacgttacgttacgttacgtacggtaccgaacgtacggtaacctaccgttaccgttacgtttaacgtttaccgttttaacgttttacggtacggttccggttacccg

SEQ ID NO: 59590 - DNA, 711 bp, Homo sapiens
  misc_feature: GYAE6OF01C67KH.26.57.F02.1.454.CMB.1.raw
  modified_base (211)..(211): a, c, t, g, unknown or other
  misc_feature (211)..(211): n is a, c, g, or t
  modified_base (349)..(349): a, c, t, g, unknown or other
  misc_feature (349)..(349): n is a, c, g, or t
tcagagactatactcacgaccggtgctcgatttagctcgatatagttgggtttggggctgggagaggagctccagccttgggattcccagctgtctccactcggtgatcggcactgaatacaagagactcacagtggtagtttgggctgagtcgttgggttttccttgttgtacttaagttttaaaaggtgtaccagtgtcgtaggtgacnggtcgtggggtggacgggtccgggggagtcgttcggtaccggacggggtcccggggggtcctaggtaactcgtcgagtggtcgcgtggtcttgtggtactcatacttcgagtcgacgtcgactatacgtcgtcggccncgtgtcggacggacgggaggtcgtggtggtacgtcgtacggtacttaagtaacgaaacctaacggtacaaacggtaacgacggactaaacttagttacgcgcgtacggtcgggtacgtcggaacgttaagggccttaacggtacctaaccgtacgtttccgaacgtaacggtagtaacgttaggtactaacggaaaggaacggtaacccggtagtacgttactcgaagaaccggtaataacggacaacggtaaccaaaggtaacggaaccaggaccctcggttaataccgttcgactacgaacgaacggtctaccggttcttaacgttactttacgttagtttcgtaacggtcggtaaccgg

SEQ ID NO: 59591 - DNA, 612 bp, Homo sapiens
  misc_feature: GYAE6OF01DC8AX.26.57.F02.1.454.CMB.1.raw
  modified_base (182)..(182): a, c, t, g, unknown or other
  misc_feature (182)..(182): n is a, c, g, or t
  modified_base (392)..(392): a, c, t, g, unknown or other
  misc_feature (392)..(392): n is a, c, g, or t
  modified_base (449)..(449): a, c, t, g, unknown or other
  misc_feature (449)..(449): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaggtntccagtgtcaggtgcagctggtggaggtccgggggagcgttggtccgaggccggggggtccctgaaactctcatgtgcgaggtctctggattcactattcagtcgactcggactatatacgtggtccgccagtctggaccgggaagggctagggagtggcgttggccgtatacgaacctaactgaacaacgtacgacgaactaatttagngtactggtccggtggtcgacgaagggtctagttaccactactctaccgagagatagntagagaacgaacgacggtacgtactactagactaaagtacgaacaacgtaccgaacggaaaccggacgacgaccggtaccgttagtactcgtacgtcgaccgtacgaccgtacgtccggttacgttacgtttaacgtttagtttttacaggttcggtaacccg

SEQ ID NO: 59592 - DNA, 852 bp, Homo sapiens
  misc_feature: GYAE6OF01D92NJ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagcttgggttttccttgttgcttaattttaaaaggtgtccagtgtcaggtgcagcgtggtgggacggtccgggggagcgttcggtccgacgggcccgggggggttcctacgaaacctctacgagttggtgacgaggtctcgtaggtacttccaacgtattcgaggtcgacctcggtcttatacgtaccggttcgggtcccgccgtacggttccggtacggggacccgggggaaagggtccggttagggtacggttcgggtcgttacgggtacccgttaagttaaaccggaaaacccgtaaaaccttaggaaaccgtaaaggtaacccgtaaccggtaaaacgtttaaagtttacgtcggtacgttcgggtaccgggtttacgggtacgtaaccggtaaacgggtaccgttaaccggttacccgaacccgttacgtacccgtacccgtaaggtaacgtaacgttagtaacgttacggaacggtaaacggaacccgtaacgggttaccgtaacgttacgtacgtaaacgtaaacgtaaccgaaaccgtaacggtaacccgttaaaacgggaaaacccggaggaacccggaaccggttaccgttacgttaacgttaccgtacggtacctaccggtaacgtaaccctaccgtttccgttaaccgtttacgtttaacgtttacgtttttacgtacggttccggtaacccg

SEQ ID NO: 59593 - DNA, 883 bp, Homo sapiens
  misc_feature: GYAE6OF01ELCPF.26.57.F02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggagtttgggctggagcttgggttttcctgttgacttaagttttaaaaggtgtccagtgtnaggtncagcgtgggtggaggtcgggggagtcgttggtccgagggcccgggggtcctagaacctctacngtgtgcgaggcgttcgtaggtacttaccaactagttaccaggtactaccgtcggtacttaattacgtacggttaccggggtccgccttaggtacgacgggaaccgggggtaaagggtccggtacgggagggtttcggtacgttcgggtaaccgttaactaaaacggaaaccctaaacgtaacgaaacgtaaacggaccggtaaccgtaacttaaactttacggtggttaccgtaccgggttccggttaccggggtaccgaacgggtaaaacgggttcgtaaccgggttaaccctaaacccttacgtaccccgtaaccggaaaggtaaaggtaagttaacggtaacgtttaaacccgaagggtaaaaccggtaaacccggtacgggttaacccgttaaagtttacccgttaaccggaaagtaaaaccgtaaggtaaacccgaaaacgggtaacccggtaaaaaccgggtaaaacgggaaccgggtaacccgtaacgggttaacccggttagttaacgttaaacgtcggtaaccgacgtaaaccggtacgtaaacccgtttccgttaactttaaaccggtttaactttaccgttttcgggtaacgttccggttaaaccgg

SEQ ID NO: 59594 - DNA, 606 bp, Homo sapiens
  misc_feature: GYAE6OF01BAEUL.26.57.F02.1.454.CMB.1.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
tcagagactatactcacgaccggtgctcgatttagctcgatatagttgggtttgggctgggagaggagctccagccttgggacttcccagctgtctccactcggtgatcggcactgaatacaagagactcaccatggagtttgggctgagctgggttttcctgttgctattttaaaagtgtaccagtgtcaggtgcagctggtggagtccgggggagcttggtccaggccggggggtcctggtaaacctcgtcatgtgtcaggtctcgtggacttcactattccgagtcgactcggctatgtacnggtccgccagtcngaccgggaagcgtggagtggcttggccgtaagttacgaaccaactgactaacgacgacactaatttnacgcgtgacgtcggngacgaagggctacggtcactactctcgagagtatacggtatcagaacgacgacggtactagctaggaaccaatacgggaaactacgggaccgtaacggaaaccggacgaaccggtaccgggtaccgttggttaactacgttcgacgtccaacggcctaacgtacccgttacgttacgttacgttacttttacgcgttacgtacccg

SEQ ID NO: 59595 - DNA, 692 bp, Homo sapiens
  misc_feature: GYAE6OF01D8ZVF.26.57.F02.1.454.CMB.1.raw
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttccttgttgtcttaattttaaaaggtgtccagtgtcaggtgcagctgggtgggacggtccggggggaggtcgtttcgggtcccgacgggcccgggggggggttcccccttaggaaaaccttccgtccagtcgtcgcgaggccttcgtggattccacgtattcagtgtactcggacttatatacgtgggtccncagtcgtggccgggaaggtctagggngtggtcttggtaccgttaagttacgaacctaaacctgtaacaagtacgacgactaatttacngctgcggttcggtgaccgtaagggtacctaggttaccgacctacgtcctaccgaagtagtagtgtaacttacgaaggaacgaacgtacggtacgtacgtcgtagaactaagtacgaacgtacgtaacctaacgaaaccggaacggacgtaccgtacgtacgttacgttaccgtagtaccgacgaacggccgtacgttacccgttacgttaacgtttacggtttaacgtttttcgacggttccggtaacccgg

SEQ ID NO: 59596 - DNA, 666 bp, Homo sapiens
  misc_feature: GYAE6OF01DWAAM.26.57.F02.1.454.CMB.1.raw
  modified_base (125)..(125): a, c, t, g, unknown or other
  misc_feature (125)..(125): n is a, c, g, or t
  modified_base (194)..(194): a, c, t, g, unknown or other
  misc_feature (194)..(194): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
tcagagactatactcacgaccggtgctcgatttagctcgatatagttgggtttggggctgggagaggagctccagccttgggattcccagctgtctccactcggtgatcggcactgaatacaagngactcaccatggagttggctgagcttgggttttcctgttgcttattttaaaggtgtccagtgtcaggtncgagcgtggtggaggtccgggggagtcgttcggtccgaggtccggtggggtcccctagaaacctccgtcgagtgtgcgacggctcgtgattcgactattcaagtcgacgtcggntagtatacgtggtccncagtccgnggaccgggaagtcgtggtagtggtccgttggaaccgttataacggaaaccctaacgtgtaacgaacgtacgacgtaacttaaagtttgtcgacgtcggacgttcgggtgaacgtacggacgtacgttccaccgtatccgtacgagtagtacgtagtagttacgaagtaacgaacgtacggtacgtagtacgtacgaactaagtaccgaacgtacgtaaccgtaacgaaaccggcgtaaaccggtaccggtaccgttacgttaacgttaccgtgtaccgacgacgtaccgtacgtccgttacgttaatttacgtttcttttccgtggttacccgg

SEQ ID NO: 59597 - DNA, 952 bp, Homo sapiens
  misc_feature: GYAE6OF01DK9UX.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtaggtttgggctggagtcgttgggtttttccttggttgtactttaaagttttaaaaggtgtccaggttgtcgaggtgcaggtcgtgggtgggagggtccgggggagtcgttcggtccgacggggtcccggggggtcctagtaacctctacagttgtcgacgtggtccgttgtacggtacttctaacgtacttacgtaggttcgtaccgtacggtacttaacttagttaccggtaccgggttcccgaccgtggtccggtaacgggaccgggggtaaggtcggtagggtcggtcggtcggttacgggtactaagtaaccgaaaccgtaaccgttacggaactaacgggtacgaacgtaaacttaagtttacgcgtacgtcggtacggtggacgtacgaacggtcgtaacgtccaaaccgcgttcgaaccgtaagtacttagtacgtacttaacgggaaacggtaacggtaaacccggtcgtaacgttaacttacggtaaacggtaaactaaaccggtaaccgaaacccggtaaccggggaaaaccccggttaaaacgggtaaaaccccgggacggggtaaaccccgttaaccccggggggtttacgtttttaaaacccggttttaagtttaaccccgggtttaacggggtaaacccccggtaaacccgttaaaccccggggttaaccgtttaaacccccgggtttttaaccgggtttaaaaacccggttttttaacggttttttttaaaacccggtttttacgggttttttaaaaccccggtaccgggggtttaccccgttttaaaaccccggggg

SEQ ID NO: 59598 - DNA, 912 bp, Homo sapiens
  misc_feature: GYAE6OF01BWM7X.26.57.F02.1.454.CMB.1.raw
  modified_base (323)..(323): a, c, t, g, unknown or other
  misc_feature (323)..(323): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttcctgttgctaattttaaaaggtgtccagtgtcgaggtgcagctggtggaggtccggggggagcgttggtccgagggcccggggggtcctagaaactctcgatgtgcaggtctcgtggtacttcactattcagtcgacgtcggactatactacgtcggggtccnccgacgtcgtacgggacccggggaaagggtcctggggtagtcgggtcgttcgggtaccgttaagttaaccggaaaccctaaaccgtagaaccgtaaacgggtaccgaccgtaaacttaaagttttaagcggtaccgttcgggtcccggttacgggtcggaaccggtaaacgggtccggttaaccgggtttacccaacccgttaacgttacccgtaacccggtaaacggtaaacggttaacgtttacggtaacgtttaacgaaacgggtaacgtaaaacccggtacccggttaacgtttaaccgttaccttacgggtaaaccctaaacggttaaccggaaacccggtaaccgtaaacccgtaaacccggggaaaaacccggtaacccggggaaaccggtaaccccggggttacccggtttaaacggttaaaccgttttaaccggttaccggtaaccgggtaccccggtaaacggtaacccgttaaaccggttaccccgggttttaaaccggtttaaacccggtttttaaacggtttttaacccgtttttttacccggttaacggggttttacccggggtttaaaccccgg

SEQ ID NO: 59599 - DNA, 949 bp, Homo sapiens
  misc_feature: GYAE6OF01DSHWU.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggatttgggctgagctggttttccttgttgctatttaaaggtgtccagtgtcaggtgcagctgggtggaggtccgggggaggtcgttggtcccgagggtcccgggggggtcccctggaaacctcgtcactggtgcgacggctcgtaggtacttcacctattccgaggttgaccgtcggtccgtaatacgttaccgtcggggtccccgaccgtaacggtccgtacgggacccggggaaaggggtccgtgggtacggttcgggtcgttacgggtcccgttaagttaacggaaaccctaaaccgtcggaaaccgtaaacggttaaccgacgtaaacgtaaacgttttacgacggtacctcgggtaccggtacggtacggaccgtaaacgggtaccgtaacgggttacctaacccgtaacttcctacccgtaagggtaaccgtaaggtacggtaacttacgtaacggtaaccgggtaaaccgtaaccgggtaaccggtttaacgttaccgttaacgggtaaccgtaaaaagttaaccgggtaaacccgtaaaccgggtaacccgttaaaccgggtaaaaaccccgggaacggggtaacccgggtaaacccgggtttaccccggttaaacggttttaaacccggttttaacccgggtttaaccggtttaacccgggaaccccggttaaaaccgggtaaccccgttaaacccggttttaccccccgggtttaaccggttttaacccggtttttaaaccggttttaacccggtttttttttaaccgttaaccgggttaccccggggtttaaaccccccggg

SEQ ID NO: 59600 - DNA, 834 bp, Homo sapiens
  misc_feature: GYAE6OF01D1RXA.26.57.F02.1.454.CMB.1.raw
  modified_base (428)..(428): a, c, t, g, unknown or other
  misc_feature (428)..(428): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggaggtttggctgagtcgttgggttttccttgttgtacttaagttttaaaaggtcgtccagtgtcaggtgcgagcgtgggtgggtacgggtccggggaggtccgtttcgggtcccggacggggccccgggggggtacccctaggaaaccttcctcgtagtggtcgccgaggtcctcgtaggtacttacacttacttctaagtcgtacctcggtacttaagttaacgttaccggtcgggtcccgtaccgtaggtaccggtacggggacccggggtaaagggtccgttaggggngttcggggtccgttacgggttaccggttaagtaaaacccaaaccgtaaaaccggtacgaaacgtaaacggtacccggactaacgtttaagttaacgtcgtacgtcggtccgggttacggtggaaacggtacggtacgttaaccggttccctaacccgtagtaccgtaaaccgaggtaaacgtgttaacgtaacgttaacggaaccggtaaaccggaaccggtacggtaacgttacgtacctacgaaacgtaaagtaaccgaaaccgacggtaaccccgtaaacggaaaccggtaccggaacgttaacccgggacttacggttaacctaggttcgaccgacgtaactaccggtacttaccggttggttttaaaccttacggtttactttggtaccggtcgttaccgg

SEQ ID NO: 59601 - DNA, 737 bp, Homo sapiens
  misc_feature: GYAE6OF01B7QET.26.57.F02.1.454.CMB.1.raw
  modified_base (181)..(181): a, c, t, g, unknown or other
  misc_feature (181)..(181): n is a, c, g, or t
  modified_base (272)..(272): a, c, t, g, unknown or other
  misc_feature (272)..(272): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttgggctgagtctgggttttcctgttgcttattttaaaaggngtcagtgtcaggtgcagcgtggtggacggtccgggggtagcttgggtccgacggccggggggtacctgaaactctcagtcgagcgaggtcncgtggtattccactagttcagttcgacttcggactagtattacggtgggtccgccagttcgtcggccgggtaaaggccgtagggtagtggtcgttggacctagttaaccgaactaaacggtcgaacgaaagttcgacgtaactaaagtttagtacgcgttcgggtcgtttaccggacggacggtaaacggcgttacgttacgaacctagtacccctagaagtacgtaagtcggtaattaccgaagaaggttaaacccgcgggttaaccgtacgtaccgttaacgaaacgttaaccgtaaggaaaccgaccgtaaccggttaaaccgaaaacccgggacgggaaccgtacccgggtagtttaaaccgttccgtttaaacgtcggttacggtaccctaaacggaccgttaccgtaccgtttacgttaacgtttaacgtttacgttttgtcccggtttacgttacccg

SEQ ID NO: 59602 - DNA, 789 bp, Homo sapiens
  misc_feature: GYAE6OF01B51P4.26.57.F02.1.454.CMB.1.raw
tcagagactatactcacgaccggtgctcgatttagctcgatatagttggggtttgggggctgggagaggagctccagccttgggattcccggctgtctccactcggtgatcggcactgaatacaagagactcaccatggagtttgggctgagcttgggttttccttgttgcttaattttaaaaggtgtccagtgtcaggtgcagcgtggtggaggtccggggggaggtcttgggtccaggggcccgggggggtccctaggaaactctcatggtgcgaggctacgtggattcactattcagtgacctcggctatatacgtgggtccgcctagtcgtggaccggggaaagggcgtgggtaggtggtcgttcgggccgttaagttaacgtaaacccctaaccgtacggaacgaaacggtaccgacgaaccgtaaattttatcggtacgtcggtaccggtcgggttacgacggaaacgggtcgtaaccgggtttaccaaccgtaaccgtccgtaacccgaagggtaacgaagttacggttaacgtttaccggaagtaaacggtaaaccggtaacccgggacgttaccgtacgtaacggtaaccgtaaaagttaaccggaaacgtaccggtaacccgttaaacggaaaaaccccggacgggtaacccgtaccgggtcccggtaggtttaaaccgttacgttcgggtacgcccgaagtaacccggcgttacccgttacgtttaacggttaacgtttttacggttttacgtacgttcccggtacccgttaacgggg

SEQ ID NO: 59603 - DNA, 770 bp, Homo sapiens
  misc_feature: GYAE6OF01DGXP7.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagcttgggtttccttgttgcttaatttaaaggtgtccagtgtcaggtgcagcgtgggtggacggtccgggggagtcgttggtcccgacgggcccggggggtcctaggtaaacctctcagtggtgcgacggctcgtggtacttacactattcgagtcgaccgtcggctaagtactaccggttcgggtccgccgtaaggtcggtacgggacccggggaaaggtcgtggggaacgtgggtaccgttaggacccgttaagttaacgaaacccgtaaaacgtcgaaaccgtaaagtaccgacgtaacttaaagtttacgtcgtcgtcggtacggttacggtacgaaccgtaacgggtaccgttaacggttaacccaacccggttacttacccgtaccgtaagaagtaacgtagtaacgtttacgaaggtaacgtaacgacgggtacttaacgtacgacgtaactaaagtacgaaacgacgtaccgtaaacggaaaaccggacggaaccgtacggtaccgttaagtacttacggcggtaaccgacgtaacgtaccgtaacccgtttaccggttaaccgtttacgttaaccggttttacgttttaccgtagggttcccggttaaacccgg

SEQ ID NO: 59604 - DNA, 670 bp, Homo sapiens
  misc_feature: GYAE6OF01EBY8M.26.57.F02.1.454.CMB.1.raw
  modified_base (419)..(419): a, c, t, g, unknown or other
  misc_feature (419)..(419): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggagtttggctgagctggttttccttgttgcttattttaaaaggtgtccagtgtcaggtgcagcgtggtggaggtccgggggaggcttggtccgagggccggggggtccctagaaactctcatgtgcaggctcgtggtattcactattcagtgacgtcggctatatacgtcggtccgcagtcgtcggaccgggaaaggccgtagggacgtggtcgttcggccgttaagttaacgaaaccctaaaccgttgaaccgtaaacggtaccgacgtaactaaacgtttntaggctgtccgttcgggtgacgaacgggtacgtacggttaccacccgtatcctaccgaaggtagtaacgtagtaacttacgaacgtaacggaaacgtaccggtacgtacttcgtagaactaaagtacgaaacgacgtaaccgtaacgaaaaccggtaacggaccgacggaccgttagtacgttacgtcgtacgacgacgtacgtacgtaccgttacgttacgtttaacttagttttacgtgttcggtaccg

SEQ ID NO: 59605 - DNA, 727 bp, Homo sapiens
  misc_feature: GYAE6OF01DSHWX.26.57.F02.1.454.CMB.1.raw
  modified_base (460)..(460): a, c, t, g, unknown or other
  misc_feature (460)..(460): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagctgggttttcctgttgcttaatttaaaggtgtccagtgtcaggtgcagctggtggaggtccgggggaggcgttggtccgagggcccggggggtccctagaaactctcatgtgcgaggctcgtggtacttcactatttcgagtcgtaccgtcggtcttaagtacgttaccggtcggggtccaccgtaaggtccgtacgggaccggggaaagggccgttaggggagttcgggtcgttacgggtacccgttaaatacggaaaaccctaacgtacggaaaccgaaacggtaaccgaccgtaataaacgttttacngtacctcggcgttcgggtacgacgtaagggcgtacgttaccaccgtactcctaccgagtaacgacgttagtacttacggaacgaacgaaccgtaccgggtacttaacgtactacgaacgtaaagtaacggaaacacggtaaccgtaacggaaaaccggacggtaccgtaccggtaccgttagtaacttacggtcgtacgaccacgtaacgtacgttacccgttacgttaactttaacgtttatttttacgaacggttccgtaacccg

SEQ ID NO: 59606 - DNA, 771 bp, Homo sapiens
  misc_feature: GYAE6OF01APSJ2.26.57.F02.1.454.CMB.1.raw
  modified_base (199)..(199): a, c, t, g, unknown or other
  misc_feature (199)..(199): n is a, c, g, or t
  modified_base (755)..(755): a, c, t, g, unknown or other
  misc_feature (755)..(755): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgtcttattttaaaaggtgtccagtgtcaggtncagctggtggaggtccggggagcgttcggtccgagggcccggggggtccctacgaaacctcgtcagtgtacgcgaggtctgtcggtattaccactacttcagtgtaccgtcggactatacgtacgttcgggccgaccgagtcgtacgggaccggggaaaggcgttagggagttcggcgtttcgggacccgttaagttaaacggaaaaccctaaaccgtaggtaactaaacggttacggaccgtaaacttaaacgttttacgcgtacggttacggtccgggtttacggacgaccggtaaggtcgtaacggtaccacccgtacgttcccgtacgaacgtaacgtaagtacgtaatttacgaaggtaacgaaccggtaacggtaccgttaacgtacgtaaccgtaagtaacgtaacgaacccgaacggtaacccgttaaaccgggaaacggttaccgggaacccggtaacccggttacgagttacttacggtacggtccgaacgtacgaaccgttcgtaacccggttacgtttacgtttacggtttacctttttacggngttccggttaacccgg

SEQ ID NO: 59607 - DNA, 741 bp, Homo sapiens
  misc_feature: GYAE6OF01CHHW8.26.57.F02.1.454.CMB.1.raw
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagtcgttgggttttccttgttgtactttaagttttaaaaggtctccgagttgtcgtaggtgcacgtcgtgggtggtacgggtaccgggggagtcgttcggccgacggggtcccgggggtacctagtaaaccgttcgtactagttcggtcgacgcggtccgtacttggtactttacacttagttacgagtacgaccgtacggtactttaacgaagttccggtcgggtcccgacgtacggtcggtacgggaaccggggaaggtcgtacggnggttacgtcggttaggtacctaagtaaaccggaaacctaaccggtnaaacgtaaacgtaccgtaacgtaagttaacgtttgccgtacgtcggtcggtacggttacgaacgtcgggactacggtaccactacgttcctaacgaggtaactgtactacgtacgaagtaacgtacgacgttacggtataccgaagtaacgtaagtaacgacgtaacgtaacgtaacggaaccgacggtacgacgtacgttactacgtgcgtacgactacgtaccgtacgttccgttaacgtttactaccgttttagttcctacggttgtaacccgg

SEQ ID NO: 59608 - DNA, 738 bp, Homo sapiens
  misc_feature: GYAE6OF01AQTNO.26.57.F02.1.454.CMB.1.raw
  modified_base (323)..(323): a, c, t, g, unknown or other
  misc_feature (323)..(323): n is a, c, g, or t
  modified_base (627)..(627): a, c, t, g, unknown or other
  misc_feature (627)..(627): n is a, c, g, or t
tcagagactatactcacgaccggtgctcgatttagctcgatatagttgggtttggggctgggagaggagctccagccttgggattccccagctgtctccactcggtgatcggcactgaatacaagagactcaccagtgggtacgtttgggcttggagtcgttcggggtttttccttggttagtctttaaagtttttaaaaggtcgtcctaggttgtacagggtgcgaggtcgtagggttggacgggttccgggggagtccgttcggtaccgacggggtccccggggggtacctacggaaacttctacgtagtcgtacgaccgnggtcttcgtaggtacttactactacttaggaacgttcgaaccgtacgggacctttaagtaacttaaccgggttccggggaccgtacttacggtcgtaccgggaaccggggaaagtcgtcgggagttcggtcttacgggacgttaataccgaaaaacctacgtagaaacgtacggtagaccctaagttaaatttcacgtcgtcggacgttaccgtagaaccgtaggtaccgttaggtaccaactcgtacgtacgagaattcaacgtatacgaagtacgaaaccgtgtactactcgacaacgtaanacggacgtacgtaacgtaacggaaacggtcgaccgtccgtacggtactagtacgtgaccggttacagcgtcttacccgtaagttcccgttaattcgttagtacggtctacg

SEQ ID NO: 59609 - DNA, 830 bp, Homo sapiens
  misc_feature: GYAE6OF01A973E.26.57.F02.1.454.CMB.1.raw
  modified_base (651)..(651): a, c, t, g, unknown or other
  misc_feature (651)..(651): n is a, c, g, or t
  modified_base (658)..(658): a, c, t, g, unknown or other
  misc_feature (658)..(658): n is a, c, g, or t
  modified_base (692)..(692): a, c, t, g, unknown or other
  misc_feature (692)..(692): n is a, c, g, or t
tcagagactatactcacgaccggtgctcgatttagctcgatatagttgggttggggctgggagaggagctccagccttgggattcccagctgtcctccactcggtgagtcggcactagaatacaagagactacaccagtggtaggtttgggctggtagtcgtttcgggtttttccctttgttagtacttttaagttttaaaaggtcgtaccgtaggttgtacgtaggtcgcgtaggtcggttgggtacgggtacggggttcccggggggagtccggtttgggtccccggtacggggggtccccgggggggttaccctaacggtaaaccgttcgtactagttaggtacgccggtacggtccgttaggttacggttattccctaagtacttacgtaacggttcggtaaccgtcggttactttaacgtacggttaccgggtccgggtaccccgtaccggtaccgttaccgggtacccggggtaacggggtaacgggtcggttagggtaggttccgggtcggttacggtacgtttaaaccgtaacgaaacccgtaaccgtacggaacgtaacgtaccgtaagtaacctttaatttacggtgtacccgtggtcggtacggtcgtaggtacggtacgtacggtccactctacacgangtaagtntacgctaagacgacgtacgtctacgtctaagaanaacgaacgtaacgaaccgtaccgtaacgaaccggacgtacgacggttaccgttacttcgtacggtactccgtacgtaagtactaccgtttacgttactttacgtttacgttcgtttaaccggtcggttccgttacggg

SEQ ID NO: 59610 - DNA, 703 bp, Homo sapiens
  misc_feature: GYAE6OF01AUVJC.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccggggggagtcgttggtccgagggcccggggggtccctgaaactctcatgtgacgaggctcgtggtattccactattcgagtcgacgtcggtctatattaccgtcggggtcccgccgtagtccgtggacccggggaaagggccgtagggacgtggtccgttacgggaccgttaagttaacgaacccaaaccgtcgaaccgtaaaggtacgaccgaactaattttagcgtactcggcggtacggtgactaacgggcgtacggttaccaccgttactaccgtaccgaacgaagtagtacggtaacttacgaacggtaacggaaacgtacggtacgtaacgtcgtacgaactaaagtacgtaaccgaacgtacccgtaaacggaaaccggtacggaacgaccgggtaccgtacgttaacttacgtcggtcgacccgtagtacctcgttacgttaccttaagtttacgttaattttcccgaggttcggtacccgg

SEQ ID NO: 59611 - DNA, 575 bp, Homo sapiens
  misc_feature: GYAE6OF01BLTNI.26.57.F02.1.454.CMB.1.raw
  modified_base (182)..(182): a, c, t, g, unknown or other
  misc_feature (182)..(182): n is a, c, g, or t
  modified_base (317)..(317): a, c, t, g, unknown or other
  misc_feature (317)..(317): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttcctgttgcttattttaaaggtntccagtgtcaggtgcagctggtggaggtccggggggagtcttggccgagggtccgggggggtccctagaaactctcgatgtgcaggctcgtggcttcacattacagtcgactcggactatactacgtcgggtccncgtagtcgacggaccggggtaaggcgtggaggtgcgtggactatacgaaaccactagacagtacacgactaattngctgcgtggnacgagctgtccatcncagagangtatatagagaagcgacgtactangtacaacgataacgaacgactacgaaaccgtaacggacggaccgacgtcgtagttacgtcgtagtcgactacggtacctacgtacccgttagtttacgttactttagtttcgagttccggtaacccg

SEQ ID NO: 59612 - DNA, 766 bp, Homo sapiens
  misc_feature: GYAE6OF01DP2Q1.26.57.F02.1.454.CMB.1.raw
  modified_base (232)..(232): a, c, t, g, unknown or other
  misc_feature (232)..(232): n is a, c, g, or t
  modified_base (503)..(503): a, c, t, g, unknown or other
  misc_feature (503)..(503): n is a, c, g, or t
  modified_base (516)..(516): a, c, t, g, unknown or other
  misc_feature (516)..(516): n is a, c, g, or t
  modified_base (606)..(606): a, c, t, g, unknown or other
  misc_feature (606)..(606): n is a, c, g, or t
tcagagactatactcacgaccggtgctcgatttagctcgatatagttgggtttggggctgggagaggagctccagccttgggattcccagctgtctccactcggtgatcggcactagaatacaagacgactcaccagtggtagtttgggctggagtcgtttcgggttttccttgttagtactttaagttttaaaaggtgtacctaggttgtacgaggtgcagtcgttggggngggtacggggtccgggggtagtccggtttcgggaccggaccggggtcccggggggtaccctaacggtaaacctcgtcgtaagtggtagacgtacggtcttcgtaggtactacgatagttacgacgttacggactccggataagttaactcggttcgggacctacgtacggttcgacgggaaccgggaaggtcggtagagggttggacttcgggacgttaactaacggaaacctaacgtagaacgtaacggactacgtaaactaattttcgngacggtgcgggtntacgacgtaggacgtagtaccactagttcctaacgaagtacgagtacgtaagtacgaaggaacgaaacgacggttacgtaactcggtaanaaacgacgtaacgaacgtaccgtaacggtaaaaccggaaacgaccggtaacggaccggttaccgaagtttaccgtagttaccggcgtaaaccgagtaacccgtacgttacggttacgtttaaacgtttaccgtttatttacggaacggtcgttaacccgg

SEQ ID NO: 59613 - DNA, 820 bp, Homo sapiens
  misc_feature: GYAE6OF01BGFPA.26.57.F02.1.454.CMB.1.raw
tcagagactatactcacgaccggtgctcgatttagctcgatataggttgggtttggggctgggagaggagctccagccttgggattcccagctgtctccactcggtgatcggcactgaatacaagtagactcaccatggtagtttgggctgagtcgttggtttcctgttgtcttatttaaaggtgtaccagtgtcgaggtgcaggtcgtggtggacgggtccgggggacgtcgttcggccgacgggtccggggggtacctacggaactcgtacgtgtgtacggcgacggtctgtacgtactccatagtcgtagtcgacgtcggtacttagtactccggtcggtaccccgtcgtacggtcgtacgggaaccggggtaagggtcggtagggtaacggttcggtacggttacgggtacccgttaacgttaacgtaaacccgaacgttacggaaacgtaacgtcccggtaacgttaacgtttaacgttaacgtcggtacgttccgggtccggtacgtacgaacggtacggtacgtacgttaccgacgtacgttacgacgacggtacgtacgtacgtagttaaccggaagttaaaccggaacgtaaccggggtaacgttaacgtacgtacgtaaacggaaacgtaacggtaacggtaaccgtaacggtaaaacccggaacgggtaacccggaaccggtcggaaccggtttacggttaacgttaccgttacgggacgtacccggtaaacgtacccgtacgtttacccggttaacgtttaaccggttttacgttacggtttttaccgtagggttacccgttaaccgg

SEQ ID NO: 59614 - DNA, 676 bp, Homo sapiens
  misc_feature: GYAE6OF01EBBQL.26.57.F02.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (468)..(468): a, c, t, g, unknown or other
  misc_feature (468)..(468): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttccttgttgcttaattttaaaaggtgtccagtgtcaggtncagcgtgggtgggaggtccgggggagtcgttgggtccgagggcccggggggtcctgaaactctcatgtcgcgaggctcgtggattcactnttcaggtgacgtcggtcttagtacgtacggttcgggtccgtaccgtaggttccggtacgggaccggggtaaaggggtccgttaggggtaggttcggtcggttacgggtacccgttaaagtaccgaaaacctaacggtacgaacgtaaacggtaccgtacggtaaccttaagtttaacncggtcgtacggtccggtacggtagacgtaacgggtcgtaacggttacccacgtacgtcctacgaggtatactgactacgaggacaacgacgtcgtatcagaactaagacgacgacgtacgaaccggaacggagaccggtagacgtattaacgtcgtcggctacgctacgtaccgttcgtattacgttatttacttgaccgtggtaccg

SEQ ID NO: 59615 - DNA, 894 bp, Homo sapiens
  misc_feature: GYAE6OF01D9F84.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttcctgttgctatttaaaaggtgtccagtgtcaggtgcagctggtggagtccgggggagcttggtccgaggccgggggggtccctgaagtctctacagtgtagcgaggctcgtaggtacttccaactattcgagttacgaccgtacggtactaacgtaacgtacggttcggggtacccaccgtacgtcgtacggggaacccggggaaagggtccgtagggtaaggtcgggtacgttacggggtaacccgttaagttaaaccggtaaaacccctaaacgttacggaaaccgtaaacggtaaccggtacgtaaaacccttaaagttttagacgtaccgtcgggtaccggttaccgggtgtaaaccgggtaaaccgggtacggtaacgggttacccgtaaacccgttacgttacccgttaacccgaaacggtaacggtactaacggttaaccgtttaccgaaaagggttaaccggaaaccgggtaccgggttaaaccggttaccgtaaccggttaacggtaaaccgtaaaacggttaaacggaaaacccgtaacggtaacccggttaaaacggaaaaaccccggggacgggtaacccggtaaccgggttaccggttaacggttaaaccgtttaccgggtacgtaacggtacccggtaaacgaaccgttaccgttaacccgggtttaaccgttaaacgtttaacccgttttaacgttttaaccggtaggttaaaccccgggg

SEQ ID NO: 59616 - DNA, 683 bp, Homo sapiens
  misc_feature: GYAE6OF01C0L27.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacaagagactcaccatggagtttggctgagcgttggttttccttgttgacttaagttttaaaaggtgtccagtgtcaggtgcagcgtggtggaggtccgggggagcgttggtccgagggcccggggggtcctagaaacgtctcagtgtgcgaggctcgtggacttccactacttcgagtgacgtcggactatagtacgtcggtcccgacagtcgcggacgggaaaggcgtggagtggcgttggaccgttaataacgaaaccctaaaccgtagaaccgtaaacggtaccgacgtaactaagtttagacgtcgttacgtcggtcggtacgacgaacggtacgtaacggttaccaaccctaactccgtaccgaagaacgtaagtagtaacgttaacgaacggaacgtaaccgaacggtacgttacgtataccgaaacgaaagtacgaaccgaacgtaccgtaaaccgaaaccggagacccgacggtaccgtagtacttagtcgtcgaccaacgtacctacgttacccgttacgttaactttacgttagttttccgaggttccgtaccg

SEQ ID NO: 59617 - DNA, 687 bp, Homo sapiens
  misc_feature: GYAE6OF01CMH9T.26.57.F02.1.454.CMB.1.raw
  modified_base (185)..(185): a, c, t, g, unknown or other
  misc_feature (185)..(185): n is a, c, g, or t
  modified_base (587)..(587): a, c, t, g, unknown or other
  misc_feature (587)..(587): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgtcttattttaaaggtntccagtgtcgaggtgcagcgtggtggaggtccgggggagtcgttggtccgacgggtccggggggtcccaggtaacctcgtacagtgtcgcgaggtctcgtggtattcgactattcgtagtcgacgtcggtacttaagtagtacgtcgggtccgacctaggtccgtacggaccgggtaaggtcgtaggtaggtcggtacgttggtaccgtaagtaaccgaaacctaaaccgtacgtaacgaacggttaccgacgaacttaattcgagtcgtggtcgtcggtagacgacggtctacggtacactactacgtacgaaggtacgtactacgtatcgaaggagtaaccgtacggtacgtcgtacgtacaacgtaagtacgaaacgtacgtaacgaacggaaaccggnggaccgtacgtaccggttagtacgttcgacggtcaccggtacgaccttacggtaccttacgttaacgttagtttaccttttagtcggtaccgttaaccgg

SEQ ID NO: 59618 - DNA, 863 bp, Homo sapiens
  misc_feature: GYAE6OF01C3PF4.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaataacaagagactcaccatggtagtttgggctgagtcgtttgggttttccttgttgtacttaagttttaaaaggtgtcctagtgtcaggtgcgagtcgtggggtacggtacggggttcggggggacggtcgttcgggtccggacgggggtcccggggggtacctacgaaaccgtctcacggtggtcgccgtaggtccgtggttacggtacttaccgacttacgttcgtacggttacggaccggttacggtacttaagttacgtaccggttcggggtccccgaccgtacggtccgtaccgggaaccggggtaacgggtcggtagggtcgtacggtccggttaggtaccgttaagtaaccgtaaacaaccgtagacgtaaacgtacggactaacgtaatttacgcgtcgtgtccggaggtcgacggacgcgtacgtaccactactacgactagagtgtacgtaacgtacgagaacgtaacgacgtactaacgtacgtataaccgtaagtaaccgtaacgtaacccgggaaccgtaaaaccgggtaaacgggaccggtaacccggggtaacccggtttacgggtttaaccgtttaaacgggtttaccccgtaaaggtacccggtaaacccgttaccggttaaaccccggttaacgttttaacccggtttaaccgggttttaaacccgttttacggtttttaaaccggttttttacgggaacccgggtttaaacgggtttaaccccgggg

SEQ ID NO: 59619 - DNA, 917 bp, Homo sapiens
  misc_feature: GYAE6OF01DTOZ1.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtaggtttgggctggagtcgtttgggttttccgttggttgtactttaaagttttaaaaggtcgtcctagttcgtacgaggtgcgtagtcggtggggtcgggacggggttccgggggacggttcggtttcgggacccgggtaccggggggtccccggggggttacctaacggtaaaccttccgtacgtagtcggtcggacgtacggtccgttcgtacgtactactacttacgttacgaggttacgtaccgtacgtacgttaacgtaccggttccggtcccgggtacccgtccggttacggtaccgggtaccggggaccggggtaacgggtcggtacgggtacggttaccgggtacggttacggttaaccggttaaaaccgtaaacccgtaaaccgtaaaccggtaacgtaaaccggtaaacgtacgtaaacgttaacgttaagttcgtcggtacgtcggtacggtcggacgtaacggtacgttaccgtacgtaacctaccgtacgtaccgtagtaacggtagtacgtagtaacggtaacgaacggtaaccgtaccgtaacggtacgttacgtaacgtaaccgtaagtaaacgtaaccgtaaaccgaacccgggtaaaccggtaaaaccgaccgggtaaccggtaccggttaaccggttacggttaaccgttacgttaccgtaaccggtacgtaacccgttacgttcccgttaccggtttaaccgtttaccgtttaaaccgttttacgttttacggtttacccgtacgggttcccgtaacgg

SEQ ID NO: 59620 - DNA, 687 bp, Homo sapiens
  misc_feature: GYAE6OF01E0NUF.26.57.F02.1.454.CMB.1.raw
  modified_base (224)..(224): a, c, t, g, unknown or other
  misc_feature (224)..(224): n is a, c, g, or t
  modified_base (349)..(349): a, c, t, g, unknown or other
  misc_feature (349)..(349): n is a, c, g, or t
  modified_base (443)..(443): a, c, t, g, unknown or other
  misc_feature (443)..(443): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatgggtaggtttgggctgagtcgttggggtttttccttgttgtcttaatttttaaaaggtgtcctagtgtcgaggtgcagcgtgggtgggngggtccgggggggaggtcgttggtccggacggggtcccgggggggtccctacgaaaccttctcagtggtgcgaggctcgtggtacttcacattcagtgactcggtactatactacgtcgggtccnccgtagtcgtagggaccggggaaggcgtgggaggtggtcgttggaccgttataacgaaaccaaccgtagaactaacgtacgacgataatttagngtctgcggtcggtgacgaacggtcgtacggttccaacctcgtcctaccgaaggagtagttagtagttaacgaacggtaagaaccggacgggtacttactacgtagaactaaagtaacgaaccgacgtaccgtaaacgaaaaccggaggaccgacggtcgtagttactacgttcgtcgaccacggtactaccgttccggttaacgtttaacgtttacgtttaattttacggtcgttccggtaccg

SEQ ID NO: 59621 - DNA, 625 bp, Homo sapiens
  misc_feature: GYAE6OF01A7TGI.26.57.F02.1.454.CMB.1.raw
  modified_base (317)..(317): a, c, t, g, unknown or other
  misc_feature (317)..(317): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggaggtccggggggaggcgttgggtccgagggcccggggggggtccctagaaacctctcatgtgcaggctctggattcacatttcagtgactcggctatatactgggtccnccagtcgtggaccgggaaaggggcgtgggagtgggcgttcgggccgttaatttaacgaaaccaaacctgaacaagtacgcgactaaatttatgactgcggtcggtgccgaagggccgtaggttcacctactccttccagacgatgtattacagtaagaacgacggcggtatcgtagacgaaagtacgaacgacgtacctaacggaaaaccgaacggacgaaccggtcgtagttaacgttacgtgtcggacctacgtacagttacccgttacgttactttacgtttatttttctacggttggtacccgg

SEQ ID NO: 59622 - DNA, 611 bp, Homo sapiens
  misc_feature: GYAE6OF01CXJJX.26.57.F02.1.454.CMB.1.raw
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccgaggccggggggtccctggaaactcgtcatgtgcaggctcgtggattcanatcagtnacgtcgctatatacgtcgggtccgccagtctcggaccgggaaggcgtggagtggcgttggaccgtatacgaaaccaaaccgtacgaacaaggtacacgaactaaatttnagntagcgtcggtgacgaggcaggtcactacgtctcgagaagactgtaattacgagtacgaaacgcggagtattacgtagactaaagtacgaacgaacgacccgtaaacggaaacgtaacggaccgaacggtccgtagtaaccgttataggtccacgtagacctacgtcccggttacgttacgtttaacttagtttttccgaggttgttaccccgg

SEQ ID NO: 59623 - DNA, 934 bp, Homo sapiens
  misc_feature: GYAE6OF01DFQH3.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtagtttgggctggagcgtttgggtttttccttgttgtacttaagtttttaaaaggtgtccaggtcgtcaggtcgcgaggtcgtgggtagggcggggttccgggggaggtcgttcgggtccggacggggtcccgggggggttcctacggaacttctcagttggtcgcggtaggtcttacgtaggtacttacctaactacgttttaccgacggttacgtaccgttcggggtacttaacgttacgttaccggggttcggggtccccggccggttacggtaccgggtaccggggaaccggggtaaacgggtcggtacgggtaagggttccggttcggttacggggtacccttaaacgttaaccgaaaacccgtaaccgttacggaacgtaaacggtaccggacgtaacgttaaattttacgtcggtacttcgggtaccgggttcggttacggaaccgggtacggtaccgttaccgggtaacctaccgtaaccgttaccgtaccggtaaaggtaggtaacgttacggttaactaccggtaaacgggtaaacggtaaccggtaccggttaaccgggtttacctacgtaaccggttaacgtaaaccgtaagggtaaaccccgtaaccggggtaccgtaaaaacccgggaaaccgaacggggtaaccgggaccggttaaccgtcggttaaaccggttcgtaaccggtaccgtacggaaacgtttcccggtaccgttttacccggttaacgtttaacggtttttaaccgtttagtttttacccggtggttaaccccgggttacgg

SEQ ID NO: 59624 - DNA, 847 bp, Homo sapiens
  misc_feature: GYAE6OF01E020O.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggtctgagctggtttccttgttgctatttaaaaggtgtcctagtgtcaggtgcagcgtggtggaggtccggggggaggcgttgggtccgacgggcccgggggggtccctgtaaacctctacatgtcgcgacggtctcgtggacttcactattcgaggtcgtacctcggtaccttaatactaaccgtcggggtcccgtccgacggttcgtcgggaacccgggggtaaacggggcgtacggggtaggtcggtcggtttacggacccggttaaattaacggtaaacccctaaaccgttagaaaccgtaaacggtacggaccgtaagtaaactttaggtacgtacgtcgggtaccggttcggggtacgaccggtaaacgggtccgttaacgggttacccaacccttacgttacccgttaccggacgtaacggtattaggtaaccgttaccgtaaaggaaccgtaaaccgggaccgggttacgttaactccggtaacgaactaaacgttaacggaaaccgacggtaacccggtaaacgaaaaccccgggtagggaaccggaacccggtaccgttacggtttaaaccggttacgttcgggttaccgaacccgttaacgacccggttaaccgttccccgggtttaacgttttaaaccggtttaccggttttaacgttttttccggtaaacggtttcccgggtttaaaccccg

SEQ ID NO: 59625 - DNA, 737 bp, Homo sapiens
  misc_feature: GYAE6OF01C9ZDF.26.57.F02.1.454.CMB.1.raw
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
tcagagactatactcacgaccggtgctcgatttagctcgatatagttgggtttgggctgggagaggagcttccagccttgggattcccagctgtctccactcggtgatcggcactcgaatacaagacgactcaacccatcggagtttgggctgagtcgtgggttttccttgttgcttagttttaaaggtntccagtgtnagttgcagctggnggacgtacggggngcgttgtccgaggtcccgggggtcctgaactcctnatgtgcaggctcgtggnttacacgtattccagttgacctcggactaatacgtacgtcgggtaccgacctacgtcgtggacccgggaaagggtcgtaggacggtggtcgttcggaaccgtaagttaaccgaaactaaaccttagaaccgtaaacgtaccgacggtaacttaaaatttcgtgcgttcgggagttccggagacgaaggtcgtaacggtttacccacctaacgtcctaaccgtagtacgtaagtagtattaacgagtaaacggaaaccgtagggtaccttaacgcgtaaccgtaaagtaaacccgttagaaaaccgtaccggtaaccgtaaaccggaaaaccggtaacgggtaaccgtaccggtacggttacgttaaacgtttagacgtacgtaccctaagtaccaccgtttacccgttacgtttaaacgtttacgttttacgtttttaccgtaggttaccggttacccgg

SEQ ID NO: 59626 - DNA, 669 bp, Homo sapiens
  misc_feature: GYAE6OF01ESZYN.26.57.F02.1.454.CMB.1.raw
  modified_base (182)..(182): a, c, t, g, unknown or other
  misc_feature (182)..(182): n is a, c, g, or t
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
  modified_base (422)..(422): a, c, t, g, unknown or other
  misc_feature (422)..(422): n is a, c, g, or t
  modified_base (532)..(532): a, c, t, g, unknown or other
  misc_feature (532)..(532): n is a, c, g, or t
tcagagactatactcacgaccggtgctcgatttagctcgatatagttgggtttggggctgggagatgagctccagccttgggattcccagctgtctccactcggtgatcggcactgaatacaagagactcaccatggagtttgggctgagcgtggttcgtgtgctatttaagtgtcagtgtnagtgcagctggnggacggtcgggngtcgtgtccgaggccgggggtcctgaactcgactagtgtcgcnggtcctagtggtattccatattcagtgacgtcggactagtacgtacgtcggtccgtccgagtccgtcggaccggggtaacggcgtggtacggtcggtacgttcggtaacgttaacgtaaccgaaaccgtaacctaggtaaaccgtaaggtaccgaacgtaacttaaacggttntcgttacgtcggtccggtacggtacggaacgaggtcgtaacggttacactaactccgtaacgaagtactagactacgtacgaaacgtacgaacgtacgggtcttaacgtntaacgtaaataaacgataaaccgtcgaaccggtaacggaaaccgacgaaccgtaccggtgttacgtacgttaggtcgtacccgaggactaccgtgttaccgttaacttagtttaacgtttctttaggccggttacgg

SEQ ID NO: 59627 - DNA, 785 bp, Homo sapiens
  misc_feature: GYAE6OF01B2OO8.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttggttttccttgttgcttattttaaaaggtgtccagtgtcaggtgcagcgtggtggacggtccgggggagcgttcggtccgacgggccggggggtccctagaaacctctcatgtgcgaggctcgtgtattcactatcagtcgactcggctatacgtacgttcgggtccgccgtaggttccgtcgggaccggggaaggtcgtagggtagtcggtcgttcggtaccgttaagttaaacgaacccgtaaaccgtcgaaccgtaacgtaccgacgtaacttaacgtttagtcggtacgttcgggtccgttacggtcggaacggtaacggtccgttaacggtttacccaacccgtacgttacccgtaccgtaacggaacgtaagttacgtaacgttcgaaaggtaacgaaaccgtaccggtaacgttacgttacgtagaacgtaaacgtacggtaaaccgaccggtaaaccgtaaaccggaaaaccggtcgggtaacccggtaaccggttccggttaacggttacgtttaccgtacggttacccgtaacgacggttaaccgtacccgttacccggtttaaacgtttaccggtttttacgtttacgttttttcggacgggttcccggttaaacccgg

SEQ ID NO: 59628 - DNA, 1200 bp, Homo sapiens
  misc_feature: GYAE6OF01AJZQM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtagtttgggctggagtcgttggggtttttccttgttgtacttaagtttttaaaaggtcgttacctagttcgtcgaggtgcacgtcgtgggtagggtaacgggtccgggggtaggtcgtttcgggtccgacgggggtcccgggggggttacccctacggtaaaccgttccgtccgtaagtttcgggttcggaccgtacggggtacccttacggttcggggttaactttaccgaacgttaccgtttacgtaacgggttaccggtaaccgtttaccggggtaactttaaccgttaacgggtttaaccccgggttccgggggttacccccggtacccggtaagggtttcccggtaccggggtaaacccggggggttaaagggggtccggtttaacgggggtacgggttccgggttaccgggttttacgggtaaccccggttttaactttaaaaacccgggaaccccgttaaaaaaccccggtaggtaaacccggtaaaacggttaaacccggggtaacctttaaaaccgttaaagtttttaaccgggtttacggtaacccgggttaggtttcccgggggtttacgggaaccgggtaacccgggtaaacgggttacccgggtaaccggtttaacccgttaaacccgggtttacccgttaacccgtaacccggggaaacggtttaaaccggggttaaacgtttaacggtaaacccgttttaaaccgggtaaaaccgggtaaaaccgggtaacccgggtttaaaccgggttaaacccgggtttaccggtttaacccgtaaccgggttaaaacgttaaaaccggtaaccggttaaaccgtaaacccggggttaaacccggtaaaacccgggttaaaccccggggtaacccggggaaacccggttaaacccgggggttacccccgggttaaggttttaaacccggtttaaacccggtttacggtaaccccgggttaacccgtaacccggtaaccccggtttaccggtttaacccggtttaaccgggtttttaaacccggtttttaacgggttttaaaccccgtttttttaac

SEQ ID NO: 59629 - DNA, 856 bp, Homo sapiens
  misc_feature: GYAE6OF01DRNKE.26.57.F02.1.454.CMB.1.raw
  modified_base (127)..(127): a, c, t, g, unknown or other
  misc_feature (127)..(127): n is a, c, g, or t
  modified_base (260)..(260): a, c, t, g, unknown or other
  misc_feature (260)..(260): n is a, c, g, or t
  modified_base (319)..(319): a, c, t, g, unknown or other
  misc_feature (319)..(319): n is a, c, g, or t
tcagagactatactcacgaccggtgctcgatttagctcgatataggttgggtttgggctgggagaggagctccagccttgggacttcccagctgtctccactcggtgatcggcactgaatacaaganactcaccagtggtagtttggctgagtcgtttgggttttcccttagttcgtactttaaaggtttttaaaacggtcgtaccgtaggttcgtacgtaggttcgacaggtcgtggggttcggacggggtccgggggngtcgtttcgggaccggccggggtcccgggggtaccctagtaaacgtccgtgagttcggngccgtaggtctcggttaggtacttaccagtacgtttagcggttaccgtcgttaccggtacttaacttaaccggtgggtttaccccggggcccgacttaaccggggtttgacccgggggttaacccgggaacggttggtacggggtaacggttggttacccggttacggacgttaaaacggtaccgaaaaccgttaccgtagaaaccgtaacggacgtacctaaagtttacgtacgtcgtacggttagccgggtggtaacgcgtaaacgggtcgttacgtaacccactacgtacccgtagaagtacgtagtacgttaagtacgaacgaacggtaccgtagacccgtttagaccggtacaagttaaccgaacgtaaccgtacgtaaccggtaaaacggtaccggtaacgtaccggtaacggttacgtaccgtttaaccgcgggttacaacccggtaggtaaccaccgtttaccggttaacgtttccgttaaagttttacccggttaggtttttaaacccggtccgttcgggtaacccgg

SEQ ID NO: 59630 - DNA, 753 bp, Homo sapiens
  misc_feature: GYAE6OF01BN3VL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagctgggttttcctgttgctattttaaaggtgtccagtgtcaggtgcagctggtggagtccgggggagcgttggtccagggtccggggggtcctagaaactctcagtgtcgacaggctacgtggtattcacgtattcgaggtgtacgtcggtctaattacgttacgtcgggtcccgcgtagttccgtacgggacccggggtaaagggtccgttaggggagttcgggccgtttacgggtacccgtttaaatttaaccggaaaaccctaaaccggttacggaaaccgtaaacggttaacccgaccgtaaaaccgtttaaagttttaactcggtaccgttagggttccggtttacggggtacgaaccgtaacgggtacccggtacggtttacccaccttacgtaccgtacccgaaggtacgagtacgtacgttacgagtaacgaaccgtacggtcgtaacgtcgtagaactaagtacgaacacggtaaccgtaagaaaccgaacggaccacccgggtagttacgtacttaacgtaggtaccgacgaacgaccgttacgttaccgttacgttaaccgtttacgtttacgttttccgaggttccgtaccgg

SEQ ID NO: 59631 - DNA, 695 bp, Homo sapiens
  misc_feature: GYAE6OF01BWSYI.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagcgtggtggaggtccgggggagtcgttcgggtccgagggcccgggggggtccctaggaaacctctcagtgtgcaggctcgtggattcactattcagtgactcggctagtagtacgtcgggtcccgccgtaggtcgtacggaccgggggaaagggcgtgggaggtcgggtcgttgggtacgtaagttacgaaaaccctaaaccgtgaactaacggtaacggacctaacgtaaatttacgtgtccgttggccggttcggtacggtacgaacgggtccgtagggttacccaacccgtacttacccgtacgaaggtagtacgtgtaacgttacgacgtaacggaaccgacggtacgtaacgtccgtagaacctaagtacgaaacgacgtacccgtaaggtaaaaccggcgaaccgtacgggtccgttaagtacgttactggtccgtacgactacgtacgttcccgtacgttattacgtttattttccgtggtccgttaccg

SEQ ID NO: 59632 - DNA, 646 bp, Homo sapiens
  misc_feature: GYAE6OF01D4GD9.26.57.F02.1.454.CMB.1.raw
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggttttccttgttgctaattttaaaggtgtccagtgtcgaggtgcagctggtggaggtccggggaggcttggtccgaggcccggggggtcctagaaactctcatgtgcaggctctggtattacacattccgagtcgaactcggactatatacgtcgggccncngtactgggaccgggaaggcgtggtacgtgtcgttaggccgttaagtacgaaacccaaccgtgaacaaggtaccncgtaataagtttncgactcggcgtcggagcgaaggtcgtaggttaccacctatccgtacgaagtagatagtacttacgaagaacgaacgtaccggcgttagtacgtacgaactaaacgttacgaaacgacgtaaccgtaacgggaaaccggaacggtacccgtaaccgggccgtttaagttaccgttacgttacggtacgacgtacgtactcgttacccgtattacgtttacgtttattttcgacgtccggttaccg

SEQ ID NO: 59633 - DNA, 736 bp, Homo sapiens
  misc_feature: GYAE6OF01DJA3H.26.57.F02.1.454.CMB.1.raw
  modified_base (682)..(682): a, c, t, g, unknown or other
  misc_feature (682)..(682): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttcctgttgacttaattttaaaaggtgtccagtgtcaggtgcagctgggtggagggtccgggggagtcgttggtccgacggggtcccgggggggtccctagaaaccttctcgatgtgacgagtctcgtggtattacgactacttcgagtcgaacgtcggtacttaatagttaccggtcgggtcctccgtaggttaccggtcgggaaccggggtaagggtccgtggggtacgtcgggtcgttacggaccgttaacttaaacgaaacccgtaaacgtacggaacgaacgtaccggaacgtaactaacgtttagcgtacgttacggtccggtacggtagaacggtaagggaccgttacggttccgaaccctaactttacccgaacgtaaacgaagtacgttaaggttaaccctacgtaacggaacgtaaaccggccgggttacttactaccgtagaactaaagtacgaaccgacgtaaacgtaaccggaacgagaccggtacgtacgtagtactacgtagccgaanacgtacctacgttcgttaacgttaatttaacgttatttcgagttccgtaaccgg

SEQ ID NO: 59634 - DNA, 797 bp, Homo sapiens
  misc_feature: GYAE6OF01A386D.26.57.F02.1.454.CMB.1.raw
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggtaggtttgggctgagtcgttggtttttccttgttgtacttaagttttaaaaggtgtcctagtcgtcgaggtgctaggcgtggggtcgggacgggtccggggggacgtcgttcgggtccgacggggtcccgggggggtccctaggtaaacttcctcgtatggtcgcggacggcttcgnggtacttcacttnttcgagtcgtacgtcgtattatacgtacggtccgggccgtccgtacggttcgacggggtaccggggaagggtcgtcgggagggtgtaccgttcggtaccgttaagtaacgaaaccctaccgtaggaacacggtacgacgtaactaagtttcgacgtcggtaggtcggtacggcgacggtacgggtacgtacggttaccacccgttgttaccctacgggaagtacgtagttaccgtaacgttacgggaaggtaaacccgaacgggtaccgtacgtttacgcgttaaccgaataaccggtaacaaacggtccgaaaccggtaaacgggaaccaaccggggtacctaccggggttagtaacttaacggtccgtaacggtccgtaaacggcgtaaccgttaccggttccgttaaaccgggttttactttaaccttttttacggtttacggtacccggttcgtttaaacccggg

SEQ ID NO: 59635 - DNA, 725 bp, Homo sapiens
  misc_feature: GYAE6OF01CYZ97.26.57.F02.1.454.CMB.1.raw
  modified_base (276)..(276): a, c, t, g, unknown or other
  misc_feature (276)..(276): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
  modified_base (637)..(637): a, c, t, g, unknown or other
  misc_feature (637)..(637): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagtcgttgggttttccttgttgtacttaagttttaaaaggtgtacctagtgtacgaggtgcgagcgtgggtggacgggtccggggagtcgtggccgacgggccgggggtacctagaaccgtctctatgngcgaggtctgtagtcttacactagttcaggttcgaccgtcggtacttaagtacgtaccgtcgggtcccgactgtccgtagggtaccgggaaacggtcggtggagttcggtcgttcgggaccgttaacgttaaccgaaacccgtaaacgtcggtaaaccgtaaacggtaccggacgtaaaccttaagttttacncggttacncgggtacgttacggngacggaaggtacgtaacggttacccacgtactcgtacgaagtagtatacgtagtacgaaggaacgtaacgtcgtacgtataccgagtaacgaagtacgaaactacgaacgttaaccggaaacgaccggacggaccggtacggttntaacgttcgtacgtacgaacgtagtaaacctccggttactaacggtttacgtttaacgtttcgttttaacggcgtttcggtaacccgg

SEQ ID NO: 59636 - DNA, 820 bp, Homo sapiens
  misc_feature: GYAE6OF01EZTM4.26.57.F02.1.454.CMB.1.raw
tcagagactatactcacgaccggtgctcgatttagctcgatatagttgggtttggggctgggagaggagctccagccttgggattcccagctgtctccactcggtgatcggcacttgaatacaagagactcaccagtggtaggtttgggctgagtcgttgggtttttccttggttgtacgtttaaagttttaaaaaggttcgtaccgtaaggttgtcgtaagggtgtccgaggccggttgggtaggggtacggggtcccggggggacgtcggtttcgggtacccggtaccgggggtcccgggggggttacccctaacggtaaaaccgttccgttacgaacgttcgggtcgccggtcggtccgttacggttaggtacttcaaccgttataccggtaggttacgaacgtccggtattaacgtacgtaccggttccgggtcccgtaccgtaggttaccggacggggtaacggggtaacggtcggtagggtaccggttgggtcggtttaccgggtaaccggttaaacttaaaccgaacccgaacgttaacgaaccgtaaggtaccgaacgtattaacgttagtcgtacgttcggtaccggtggtacacgggtaacgccggtacgtaccacgttacgtcgtacaggtagtatatacgtacgagacgaaccgtcgtcgacgtctaacgagaactaaccggataccggtaacgaaacggtaaccgacggagtacccggttgacccgttagtaccgttggacctagtacccgacgttacggtaccgttacttaaacggtcgtttacgtcgttaaccgtcggttaccgg

SEQ ID NO: 59637 - DNA, 803 bp, Homo sapiens
  misc_feature: GYAE6OF01ALAOE.26.57.F02.1.454.CMB.1.raw
tcagagactatactcacgaccggtgctcgatttagctcgatatagttgggttgggcgtggagaggaccgcctccgtacgccgttgggtacttcccagtcgtgtctccactcggtgagtcgcaactgaaatacaagagactacgaccgtaggtcggtagttgggccttggtacgttcgtttgggttttccttagtttaggtactttaagttttaaaaggtcgtaccgaggtgtacgaggtgtcgtaggtcgtgggtgggacggtccggggtagtcgttcgggtcccggtacggggtcccgggggtcctacggtaaacctcgtcgtacgtcgtcgtacgcggtctcgtacgtactcgtatacgttacgtagtcgtactcgtacgtacgtacggtccggtccggtcgtacggtacggtacggtacgggtacggtaacggtggtaggttacggtcgtacgtacggtaacgttaacgtaaccgaaaaccgtacgtaacgaacgtaaacgtacgtaactaacttaagtacgtacgtacgtacgtacggtaggtaaccgacgtaccgttacgtaaccgttacctaacgtccgtaaccgtacgtaagtaacgtaacgtacgtaacgacgtaacgtaacgtaacgtaccggtaacgtacgtacgtaacgtaacgtaacgtacggaaccgtaacggaacgaaccgtaaacggtaccgtaaccgtacgtaccgttagtacgtacgtagtacgacgtacgtacgtacggttacgttacgttaacgttacggtttacgtacggtcggtcccggtcg

SEQ ID NO: 59638 - DNA, 652 bp, Homo sapiens
  misc_feature: GYAE6OF01E2OGA.26.57.F02.1.454.CMB.1.raw
  modified_base (195)..(195): a, c, t, g, unknown or other
  misc_feature (195)..(195): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtncagctggtggaggtccgggggagcttggtccaggccgggggggtcctgaactctcatgtgcaggctcgtggattcgactattcagtgactcggctatatactgggtccgccgagtctcggaccgggaaagggtctgggagtggcgttggccgtattagaacccaacctgacaagtacgcgactaatttacngtacctggccgttcggngacgaagggctacggtacaccctactactccagtaagatagtacttacgagagaaccgacggtacgtatctagaactaaagtagaaaccactaccgttaacggaaaaccggtacggaaccgtaccgggtaccgttacggttaacttaccggttaggtcgtacccggaacgtaacccgtaacgtacccgggttaccgttaacgtttaaccgtttacgttttttacccgttaggttacccggttaccccgg

SEQ ID NO: 59639 - DNA, 622 bp, Homo sapiens
  misc_feature: GYAE6OF01CE940.26.57.F02.1.454.CMB.1.raw
  modified_base (567)..(567): a, c, t, g, unknown or other
  misc_feature (567)..(567): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagcgtgggtgggacggtccggggggaggcgttggtccgacgggtccggggggggtccctacggaaacttcgtcagttgtcgcgaggtctcgtggacttcactattcgagtacgacgtcggactattactacgtcgggtccgcgacgtcgtcggaccgggaagggcgtggagtggtcgtcggtactagttaacgaaccaacctagaacaacgtcgacgataaacttatgcgtgcggtcggtagagaacggcgtacgtaccactactctaccagagatagatagaagtaacgaaccgacggtcgtactcgtacgaacaagtacgaacgaacgaccgtaacgaaacggacgaccgacggtcgtactacttacgngtcgacacgactactaccgttcgttaagttacgttattttacgtcggtcgtaccg

SEQ ID NO: 59640 - DNA, 854 bp, Homo sapiens
  misc_feature: GYAE6OF01E5QIW.26.57.F02.1.454.CMB.1.raw
  modified_base (412)..(412): a, c, t, g, unknown or other
  misc_feature (412)..(412): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggtagtttgggctgagtcgttgggtttttcccttgtttgtacttaagtttttaaaagggtcgtaccgtaggttgtcgaggtgcgaggtcgtgggtggggacggggtcccggggggtagtccggtttcgggtcccggacggggtccccgggggggttaccctaggtaaaccttcgtacgagtggtcgcgacggtcttcggtagtaactttaccaactacgtttacgaggtacgtaccgttccggtacttaagttacgttaccggtcggggtaccccncgtacgttcggtacggaaccggggtaaacggggcgttacgggtaaggtttcgggccggtttacgggtacccgtttaaagttaacccggaaaaccccgtaaaccgtaacggaaaccgttaaacgggtaaccgacggttaaactttaactttaggtcggtcgttagtcccgggttgggtaccgacggtaacggtccggtaacgtccctaacccgtcgttaccgtacgaaggtactagttcgtaacttacggaagaacggtaaccgacggtacttagaaccttagaacgtaactaacggaacctacggtaaccgtaaaccgggaaacccgaggtaacccggcggttaccgttacgttaccgtacgttcggacccgagaaccgtctaccgttaccgtttacgttacgtttaacgttttaccttttacgacggttcccggtaaccgg

SEQ ID NO: 59641 - DNA, 1029 bp, Homo sapiens
  misc_feature: GYAE6OF01CYNMT.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagcttgggttttccttgttgcttattttaaaggtgtccagtgtcaggtgcagcgtggtgggaggtccggggggaggtcgttcggtcccgtacggggcccgggggggtcccgtacggtaaaccgtctccgaagtggttcgacgacggtccttccgttaggtacttactactagttcctaggtcgtaacctcggacttaactacgttaaccgtcggggttcccgaccgtaggtcggttacgggaccggggaaacgggtcggtagggtacggttcgggtcggtttacgggtacccggttaagttaaaccggtaaaaccccgtaaaaccgttacgggtaaaccgtaaaacgggttacccggtaaccggtaaaaccgttaaaagttttttaacgtagggttcccgttacggggttaccgggttccggggttacggaaacccggtaaaggggtaccggttaaccggggtttaccccaaacccggtttaaccgttaccccggttaaccgaaacccgggtaggttaaaccggtttaacgggtaaacgtttaccgggaaaaggtaaccccggtaaaccgggtaaaccgggtaccggttttaacgtacccgtttaacgtaaccggttaaaaacggtaaccggttaaaacgaacccgggtaaacccgttaaaccgggggaaaaaccccgtaaaccggggtaaccgggttaaccccggggtaaccggtttacggtttaaacccgtttacccggtaagggtttaaccccggaacccttaaaccgggtaaccgaaacccccggtttttacccggtttaacgggttttaaaccgttttaaacggttttacggtttttttaaacccgggaccggttttaacccggggttaaccccg

SEQ ID NO: 59642 - DNA, 526 bp, Homo sapiens
  misc_feature: GYAE6OF01DZFRG.26.57.F02.1.454.CMB.1.raw
  modified_base (291)..(291): a, c, t, g, unknown or other
  misc_feature (291)..(291): n is a, c, g, or t
  modified_base (370)..(370): a, c, t, g, unknown or other
  misc_feature (370)..(370): n is a, c, g, or t
  modified_base (514)..(514): a, c, t, g, unknown or other
  misc_feature (514)..(514): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccagccgggggggtccctgaaactctcatgtgcaggctctggattcacattcagtgactcggctatntactgggtccgccagtctgccgggaaggctggagtggcttggccgtattagaaccaactgacaagtcgcgacaatttangctgcgtcggtgcaaggcaggttcaccatctcccagagatgattcagagaacacggcgtatctgcaaatgaacagcctagaaaccgaggacacggccgtagtacttactgtcgccagcactccgtcgtacttacgtatttttcngttcggtacccg

SEQ ID NO: 59643 - DNA, 962 bp, Homo sapiens
  misc_feature: GYAE6OF01D6TIQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcacatggtagtttgggcttggagtcgttgggttttccttggttcgtactttaaacgttttaaaaggttcgtaccgagttgtccgaggtgccgagcgttggggtagggacgggtcccgggggggtaacgtccgtttcgggtacccgggacgggtcccccggggggggttcccctaaggtaaacccttaccgtacgtaacgttggtccgacgtacgggtccttacgttaggtaacctttaccaagttaccgttaccaacgggttacggtaccgttaccggggtacctttaaagttaccgtaccgggttccgggccccggtaccttacggggttcccggtttaaccgggggaacccggggggtaaaacgggtccggttaggggtaacggtttccggggtaccgtttaccggggttaccgttaaaccggtaaaacccgtaaaacccccggtaaacgtacggtaaacccggtaaagggttaacccgaaccggttaaacttttaaagtttaccgtcggggtacccgttacgggtaccccggggtttaggtaaccggtaccggtaaacgggttacccgttacgggttaaccctacccgtaaccgttaccgaacccgttaaggtaaccgacggtttaaacgtaaccggtacgtaagggtaaacgaacccgtcggtaaccgttacgtaccgtaacgaacgttaacgacggtaaacgaccgtaaccgtaacgaaaccggtaacggtaccgtaacggttacggttactacgttacgtcggaccgtacctaggaaccgttcgtaccgttacgttacgtttagttactttcgtccgtcgttaacgg

SEQ ID NO: 59644 - DNA, 775 bp, Homo sapiens
  misc_feature: GYAE6OF01BSP4F.26.57.F02.1.454.CMB.1.raw
  modified_base (396)..(396): a, c, t, g, unknown or other
  misc_feature (396)..(396): n is a, c, g, or t
tcagagactatactcacgaccggtgctcgatttagctcgatatagttgggtttgggctgggagaggagctccagccttgggattcccagctgtcctccactcggtgatcggcactagaataacaagagacctcaccatggtagtttggctgagtcgttgggttttccttgttgtacttaagttttaaaaggtcgtccgagtgtcgaggtgcgagcgtgggtgggacgggtccgggggaggtccgtttcgggtccggacggggtcccgggggggtcctacggtaaaccgtctacgtagtggtcggacgacggtctcgtgtacttacactattcgagtcgtactcgtatagtactcggtcgggtaccgcgtacgttcgacgggaacgggaaggtcggnggcggtaggtcgttacggtaccgttaagttaaccgaaacctaacgtacgaacgtaaacggtacgacgtaacttaagttactcggtcgtcggtaccggttacggtacgacggtaacgggtacgtaacggttaccaaccgtacgttccgaaacgaggtaagtaagttcgtaataaccggaagtaaaccggaaaccgtacggttcgttaacgtcgtaaacgaaagtaacgtaacgaaaccgaaccggtaacgaaaaaccggaaaccggacgacgtacccggtacggttgtaacgttacggtccgacgtaaccgacgtaacttaccggtacccgttttaaagtttacttacggtttttaactttaccggtggtaccgttaccg

SEQ ID NO: 59645 - DNA, 1007 bp, Homo sapiens
  misc_feature: GYAE6OF01AUOCH.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtaggtttgggctgagtcgttgggttttccttgttgtacttaagttttaaaaggtgtcctagttgtacgaggtgcaggtcgtgggtagggacgggtccgggggaggtcgttcggtaccggacggggtcccggggggtacctagtaaacctcgtacgagttcggtagcgtacggtccttacggtacggtaacttaccgtaactacgttaccgaacggttacggtaaccgttcggtaaccttaagttacggtaccggtcgggttacccgacgtaacgttcgggaaccgggtaaccgggggtaaagggtcggtcggggtaacggttccgggttacggtttaccgggtaacgttaaacgtttaaaaccggaaaacccttaaaccggtaacgtaaccgtaaaaccggttaaacgggtaacctaaacgtttaaagttttaaacggtcgtaccggttacggtaccgggttacgggtaaccggtaacggtaacggtaaccggttaacggttacccctaaacgtacccgtttaacgtaaccgggaaagtaacgtacgttacgggttaaaactacgggaaacgtaaccggaaacccggttacggtaaccggtttaactacggtaaacgtaaaacctaacggtaaaccgggtaaccgaaacgggttaaacccggtaaaacggggtaaaacccggacgggttaaaccggaccccggttttaaacgggtaaacgtttaacccgttacggggtttaaccaacccggggtacgtttaaaacccggaccgtttaaacccggttaaccgggtttaaacccttttttaacggttaaccgttttttaaacccgggtttacggtaaaccggtttcccggtaaaccccggg

SEQ ID NO: 59646 - DNA, 778 bp, Homo sapiens
  misc_feature: GYAE6OF01A2BS2.26.57.F02.1.454.CMB.1.raw
  modified_base (738)..(738): a, c, t, g, unknown or other
  misc_feature (738)..(738): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttcctgttgtacttaagttttaaaaggtcgtcctagtgtcaggtgcagcgtgggtagggaggtccgggggtagtcgttacgggtcccgacggggtcccgggggggttcccttaggtaaaaccgtcgtacctagttcggtcgcgtaagggtccttcggtaggtaactttccgaaccgtagtttccgaacgtccgtaacgttcggtacttaagtacgtaccggtacgggtccccgtacgacgttccgtacggggtacccggggtaaagggtcgttgggtcggtacggtaccgttacgggtaccgttaacgttaaacggaaacccttaaccgtacgaacgaacgttacggaccgtaacgtaactttagtacgtcgacggtcggtacggaggtacgtaccgtaggggtaacccttcgtaacccggtactcgtaccggtaacgacgtagtacgtagttacgaaggtaacccgaagtaccggtagtcccttagactacgaaacgttacgaacgtaacgaccgtaagaaccggaaccgtcgaaaccgttcggtaagtttctaacgtccgaggtccaaccggtttangttacccttgttaactttcgtaactttggttaccgcggtc

SEQ ID NO: 59647 - DNA, 982 bp, Homo sapiens
  misc_feature: GYAE6OF01B9DR3.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtagtttgggctgagtcgttgggttttccttgttgcttaagttttaaaaggtcgtccagtgtcaggtgcaggtcgtggggtgggacgggtccggggggtaggtcgttcgggtcccggacggggtccccggggggggttacccctacggtaaaaccgttcctaccgtacgttggtggaccggtacggggtcccttcggttacgggttaactttacctaaccgttaacgtttacgaacgggtttacgaacccggttccggtactttaaacgtttaacgttaaccgggttcccgggggtccccgtaccggttacggttacccggtacggggtaccccggggggtaaaagggggtccgttagggggtacggttcggggtaccgtttacgggtaacccggtttaacgtaaacccgtaaaaccccgtaaaacgtacgaaaaccggtaaacgtaccggtaaccggtaaaactttaaacggttttaaccgtcggtaccgggttcggtacccgggttaccgggtacggtaaccgggtaacggtaccgttacggttaacccctaaccgttaaccttacccgtaaccgtaaagggtactaacggttagtaacgttaccgaaacggtaacggaaccccggtaaggtcgttaaccgtcccgtaagtaaacgtaaacgtaccgaaaccgtacggaacccgtaaacggaaacccgggacggtaacccggacgggttaaccggtacgtttaaccgtaacgttcggtacgttaccggtaagtcccggttaacgttacccggttttaaccgttacgttttaaccggtttaatttttcccgggtaaggtttccggttacccggg

SEQ ID NO: 59648 - DNA, 767 bp, Homo sapiens
  misc_feature: GYAE6OF01EVG3G.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggaggtttgggctgagcgttgggttttccttgttgcttagttttaaaaggtgtcagttgtcagggtgcagcgtaggggtgggagggtcccggggggaggtcgtttcgggtcccggacggggccccggggggggttacccctagggaaaaccttccgttccgtagtggttacggccgtacggccgttccgtagggtactttaccaacttacttacgaggttcggaccttcggacttagtacttaccggtcgggtccgaccgtaggttccgtcgggaccggggaaagggtcgtgggaggtcggtcgttcggcgttaactaacgaacccgtaaccgtagacgaacgtacgacgtaatattacgtcgaccggtcggtacggtgacgacgggtctacgggttcctaaccgtactcgtaccgaggaagtagtagtacgttacgaagtaacgaaccggtaccggtacgttataccgtagtaactaaacgtacgaacgtaccgaaccgtaaacggaaaccggacggtaaccggacggttaccgttacgttacgttacgacggtaccgacgtacgtacgtacgttaccgtacgtttacgtttacgtttacgttttacgtacggttccgtccgttaacgggg

SEQ ID NO: 59649 - DNA, 647 bp, Homo sapiens
  misc_feature: GYAE6OF01CAE9K.26.57.F02.1.454.CMB.1.raw
  modified_base (314)..(314): a, c, t, g, unknown or other
  misc_feature (314)..(314): n is a, c, g, or t
  modified_base (418)..(418): a, c, t, g, unknown or other
  misc_feature (418)..(418): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttggtccgaggcccgggggggtccctagaaacctctcatgtgcaggctgtggtatcactattcagtcgactcggctatatacgtgggtccncgagtctcggacgggaagggtcctagggagtggtcgttcgggtaccgttagttaacgaacccaaccgtagaaccgaaacgtacgacgtaactaatttacgagtntcggtacgtcggtgacgtaacggcgtacggttcaactacgtcctacgagagtatagactacgaagacgaacgacgtacgtatcgtagactaaagacgaacgtacgtaaccgtaacgaaaccgaacggacccgacggtaccgttacgtaacgttacgtacgtcgaccgtaagtccgaaccgttccgttaacgttactttacggtttacttttacgaggttcccggtaccg

SEQ ID NO: 59650 - DNA, 706 bp, Homo sapiens
  misc_feature: GYAE6OF01B1N32.26.57.F02.1.454.CMB.1.raw
  modified_base (173)..(173): a, c, t, g, unknown or other
  misc_feature (173)..(173): n is a, c, g, or t
  modified_base (188)..(188): a, c, t, g, unknown or other
  misc_feature (188)..(188): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagctggtttcctgtgctatttaaagngtccagtgtcaggtncagctggtggagtccggggagcttcggtccgaggccgggggtcctagaactctcacgtgtgcacgtctcgtggattccgacattcgaagttgaaccgttcggaccttagtaacgttacgttcgggtcccgtccgaggtaccgtacgggaacccggggtaaagggccgttacggggacggttcgggtccgtttacgggtacccgtttaaacgtttaaccggaaacccctaaaaccgtcggtaaaccgtaacggtacccggaccgtaacgtaaacttttacggtgtacgtacggtccggtcggtacgacgaacgggtcgtacgggttaccaccgtacgtccgaaccgtaggacgtactacgtacttaacgagtaacggaacgtacgtaccgtagtcgacgactaagacgtaacagtacccgtaaacggtaaccggacgaccgacggtaccgttagttacgtactcggactacgaccgactcgtacgttcgttacgttacttagtttcgtgtcccgtacgg

SEQ ID NO: 59651 - DNA, 816 bp, Homo sapiens
  misc_feature: GYAE6OF01DDLUT.26.57.F02.1.454.CMB.1.raw
  modified_base (540)..(540): a, c, t, g, unknown or other
  misc_feature (540)..(540): n is a, c, g, or t
  modified_base (561)..(561): a, c, t, g, unknown or other
  misc_feature (561)..(561): n is a, c, g, or t
tcagagactatactcacgaccggtgctcgatttagctcgatatagttgggtttggggctgggagaggagctccagccttgggattcccagctgtctccactcggtgatcggcactagaatacaagagactacaccagtgggtaggtttgggcttagagtcgttgggtttttccttggttcgtacgttaaagtttttaaaagggtcgtacctaggttgtacgagggtcgcgaggcgttggggtagggacggggtccgggggaggtccgttcggggccggacgggggtccccgggggggttacctaacggtaactctacgagttggcgcgacggtcctgtaggtacttacaactacgttacgtaggtcgtaccgtacggtctaagttacgttcgggtaccgggtccccgacgttcgtaccggtacggggaccggggtaaacggccggtaggggtacggtcggttcgtacgggttacccgttaaagtaaacccgaaaacccgtaaccgtaggaaacgtaaacgacgacgtaaacttaattcgngtaccgtggtcgggttacggngacggtaacgcgtacgtccacgtactcgacgagtacgtagtacgtacgtagaacggaacgtaacggacgtagtacgtagtaacgaactaaacgtaacgaacgtaaccgaaccgtaaaccggaaaccggaacgaccggtaacggtaccgttacgttaacgacggttacgaccgaacgtaacggtaccgttccggtaacccgttttacgttaaccgtttacgttttacttttaccggttacgggtccgttaaccggg

SEQ ID NO: 59652 - DNA, 821 bp, Homo sapiens
  misc_feature: GYAE6OF01AJGUI.26.57.F02.1.454.CMB.1.raw
  modified_base (312)..(312): a, c, t, g, unknown or other
  misc_feature (312)..(312): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgtacttaattttaaaaggtgtaccagtgtcgaggtgcaggcgtgggtggacggtccgggggaggtcgttcgggtccgacggggcccgggggggtccctaggtaaaccgtctcgtagtcgtgcgacggcttcgtggtactcaactntcgtagtcgtacgtcggtactaagtagtaccgtcgggtcccgtaccgtaggttccggtacgggaccggggtaagggtcgtgggtacggtcggtcgttacgggtaccgttaagtaaccgaaaacccgaacgtacgaacgtaaacgtacgacgtaatactttagtcgcgtggtcgtacggtacgacgaaggtacgttacgtaccaccttatacccgtacgaaggtaacgtagtagtacctaggaacgtaacggaaccgtacgggttactacgtacgtaacgaaaccgtaaggtacgaaacccgaacgggttaccggtaaaaacccgggtaaaacccgggtaccgtaaaccgggtacccgggttaacgtaacccgggtttaaagttaccgggttaggtaaccccggtacccgttaaaccggaaccgttaacccgggttcccgttttaaacggtttaacgttttaacccttttaaagttttcccgggtaaaccggtttccggttaaaccccgg

SEQ ID NO: 59653 - DNA, 754 bp, Homo sapiens
  misc_feature: GYAE6OF01DCUZ8.26.57.F02.1.454.CMB.1.raw
  modified_base (130)..(130): a, c, t, g, unknown or other
  misc_feature (130)..(130): n is a, c, g, or t
  modified_base (739)..(739): a, c, t, g, unknown or other
  misc_feature (739)..(739): n is a, c, g, or t
tcagagactatactcacgaccggtgctcgatttagctcgatatagttgggtttggggctgggagaggagctccagccttgggattcccagctgtctccactcggtgatcggcactgaatacaagagactnaccatggagtttgggctgagcgttgggttttccttgttgtcttaagttttaaaaggtgtccagtgtcaggtgcgagcgtgggtgggaggtccgggggagtcgttggtcccgacggggtcccggggggtacccctaggtaaacctccgtacgtagtggtcgcgtaggtctcgtaggtacttcaactattacgagttacgacgtcggacttagtactcggtcggtcccgccgtagtccgtacgggaccggggtaaggtccgtagggtacgttcggtcggttcggtaccgttaacgttaaccggaaacctaaccgtgaaacctaacggtaccgacgtaacgttaaatttcgtacgtcctacgggtcgttacggtcgtaacggacggtaacgtacggttcccaccgtacgtccgtaacgagtacgtagtagtacgttgaaaggaacgtaacgacggttacttacgtcgtagaacgtaaatacggaacctaagtaccgtaaacggaaaccggaccgtacggaccgttacggttaacgtacgtacgtgggtaacccagttaacgggtacctaccgttaccgttaacgttttaacggttacttttacgtttaccgnggtttcccgtaaccg

SEQ ID NO: 59654 - DNA, 748 bp, Homo sapiens
  misc_feature: GYAE6OF01BBYTP.26.57.F02.1.454.CMB.1.raw
tcagagactatactcacgaccggtgctcgatttagctcgatatagttgggtttgggctgggagaggagctccagccttggattcccagctgtctccactcggtgatcggcactgaatacaagagactcaccatggtagtttggctgagcgttggttttccttgttgtacttaagttttaaaaggtgtccagtgtcgaggtgcgagcgtggtggagggtccgggggagtcgttcggtcccgacgggtcccggggggtccctagtaaacctcgtacgagtgtcgtacgacggtcgtcgttaggtacttacacgtattcgagttcgtacgtcggtactatacgtacggtacggtccgacgtagtccgtacggaccgggaaggtcgtggtacgtcggtaccgttacggaccgttaagttaaccgaaaaccgtaacgtacgaacgtaacgtacgaacgtaactaatttacgcgtacgtcggtcgtacggtgacgtacggtcgtacgttaccaccgtacgtcctacgagacgtagtagtacgttagacgtaacgaaccgacggtactagtacgtacgaactaaacgtacgtaaccgtacgtaaccgtaaaccggaaaccgaacggtaccgaccggtaccgttaaggttaccgttaaaccggttcgaaccgtaccgaaccgtacgtaccccgtttaaccgttaaccgtttaacgtttaccgtttacgttttaaccggtggtttcccggtaacccg

SEQ ID NO: 59655 - DNA, 875 bp, Homo sapiens
  misc_feature: GYAE6OF01C32SP.26.57.F02.1.454.CMB.1.raw
  modified_base (214)..(214): a, c, t, g, unknown or other
  misc_feature (214)..(214): n is a, c, g, or t
  modified_base (858)..(858): a, c, t, g, unknown or other
  misc_feature (858)..(858): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagtttggctgagtcgttgggttttccttgttcgtacttaagtttttaaaaggtcgttcctaggtcgtcgagggtcncgagtcgtggggtgggtacgggtccgggggaggtcgttcgggtccgacggggtcccggggggttccctaggaaacctctacgtagtgtcgacgacggtctcgtaggtactacgactacgttcgtaacgtcgtaccgtcggtaccttaagttacgttaccggtcgggtacccgtccgtaacggtccgtacggggaacccggggtaaagggtccggtacggggtacggttcgggttacggtttacgggtaacccggttaaacgttaaacccggtaaaacccgtaaaaccgtcggtaaaacggaacgttaacccggaaacgttaaaccgttaagttttaacgtcggtaaccggttcggttaccgggttacccgggtagtaacccgggtaacgggtaccggttaacccggtacctaacccgttaacgtaccccgtaacggaaacgttaagtacgttacggttaacgtacgaacgtaacggaaccgtaccggtattacgtacgtacgaaacgtaaagtaccaacgtacgtaaccggaaacggaacgtaaccggacgtaccggacgtttacgtaccgttacgcgtaaccgcggaactccgttacgttaccggtttaacgtttaacgtttacccgtttagtttaacccggnggtttcccggtaaccgg

SEQ ID NO: 59656 - DNA, 668 bp, Homo sapiens
  misc_feature: GYAE6OF01A6IS3.26.57.F02.1.454.CMB.1.raw
  modified_base (279)..(279): a, c, t, g, unknown or other
  misc_feature (279)..(279): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggacggtccgggggagtcttggtccgagggcccggggggtccctagaaacctctacagtgtgcaggctcgtggnttcacgtattcgagtgacgtcggctaagtagtacgtcgggtaccgccgagtcgtggtaccgggaaaggctgggagtgggcttcgggccgttaagtaacgaaaccctaaaccgtcgaaacgtaacgtaacgcgtaaacctaaatttgacgtacgtcggtcggttcggtacgacgtaaggtaccgtaggttaccaccgtagtccgtaccgaagtagtacgtagtaacgtcgaacgaacgtaacgacggtacgttaacgtctaagacaaacgtacgaacgacgtaaccgaacgtaaaccggaacggaccgacggtaccgtagttactacggtgtacgaccacgacctacgttccgtacgttatttacgttacttttacgtacgtcggtaccg

SEQ ID NO: 59657 - DNA, 783 bp, Homo sapiens
  misc_feature: GYAE6OF01AZ35T.26.57.F02.1.454.CMB.1.raw
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagagactatactcacgaccggtgctcgatttagctcgatatagttgggtttggggctgggagaggagctccagccttgggattcccagctgtctccactcggtgatcggcactgaatacaagagacctcaccatggagtttgggctgagctggttttcctgttgctattttaaagtgtccagtgtcaggtgcagtcgtggtggacggtccgggggagccgtttggtccgagggcccggggggttcctggaaactctctatgngtcaggtctgtaggcttcactattcagtgactcggtntagtntacctgggtccnccgtagtcgtacggacccggggaaaggtcgtacgggtagtcgggtcgttacgggtcccgttaagttaaccgaaaccctaaaccggttgaaaccgtaaacgggtaccgaccgtaacgtaacttttacggtacggtaccgttcggtaccgggttaccgggttacggacccggaaagggttacccgtaaacgggtttccctaaaccggtactttaccccgtaaccgggttaacgtaaacggtacgtttacgttaacttccgaaaaggtaccgtaaaccgacggttacgtaacgtcgtacgtaacgaaagtaccggaacgtaccgtacccgtaacgaaaccggtaacgacgtaacccggtcgtaacgttacgtacccggtgtcccggtaacaccggtccgtaaccgttacgtttaccgttaaaccgttttacggttttacttttaccgacggtttccccggtaaaccgg

SEQ ID NO: 59658 - DNA, 886 bp, Homo sapiens
  misc_feature: GYAE6OF01BKY87.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttggttttccttgttgctattttaaaaggtgtccagtgtcaggtgcagctgggtgggaggtccggggggaggtcgtttgggtcccgacggggtccccggggggggtccccttacggtaaaaccttccgttaccagttggttacgccgacggggccttccgtgggtacttccaacctattctaggtcggtaaccgttccgggtaccttaattacgttaaccgtcggggtaccctaaccgtacggttcggtacgggaccgggggtaaaggggcggtagggtacggtcgggtccgtttacgggtacccgttaacgtttaacggaaaacccctaaaccgtacggaaacctaaacggtaccggtacgtaacttaaagtttacgtacggtccgtagggtccggttacgggtcgaccggtaacgggtcgtaacgggtttcccaacccgtacgtaccgttaccgaaggtagtacgttagtaaccgttacgaacggaacggtaacggaacccggttacgttaacgttccgtaaccggaactaaaccggtacgtaaaccgaaccgggtaacccgttaaaccgggaaaaacccggtaacgggaacccggtacccggtaccgggttagttaaccgttaccgttacggtaccgtaacccgtaggtaaccctaccggtttaccgggttaccgtttaacggttttaaccgtttttagtttttcccggaaggtttcccgggttaaccccgg

SEQ ID NO: 59659 - DNA, 779 bp, Homo sapiens
  misc_feature: GYAE6OF01E0USA.26.57.F02.1.454.CMB.1.raw
  modified_base (420)..(420): a, c, t, g, unknown or other
  misc_feature (420)..(420): n is a, c, g, or t
  modified_base (434)..(435): a, c, t, g, unknown or other
  misc_feature (434)..(435): n is a, c, g, or t
  modified_base (481)..(481): a, c, t, g, unknown or other
  misc_feature (481)..(481): n is a, c, g, or t
  modified_base (612)..(613): a, c, t, g, unknown or other
  misc_feature (612)..(613): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (718)..(718): a, c, t, g, unknown or other
  misc_feature (718)..(718): n is a, c, g, or t
tcagagactatactcacgaccggtgctcgatttagctcgatatagttgggtttggggctgggagaggagctccagccttgggattcccagctgtctcactcggtgatcggcactgaatacaagagactcaccagtgtaggtttggctgagtcgttgggttttccttgttagtacttaattttaaaaaggtcgtcccgtaggttcgtacgacggtcgacgtacggtcgtagggtacgggtacgggtaccgggggtacgtccggttcggtaccggaccgggggtacccggggttcctaagtaaccttactcgtagtcggtacgtacccgttaccggttacggaactttaccgaacttacgttaccgaagttaccgcgaaccgttacggtaccttaccggtaccgttaccgtaccgggaaccnggttaccccgtaanntaccggtaacggtaccggaacgggtaccggtacggtacgttacggncgttaggttaccgtaaccgtaaaccgtacgtaaccgtaacgtaacgtacgaaccgtaacgttacgtacgtacgtaggtacgtacggtacgtacgtacggtacgtacggtacgaccgtactaccgtaccgtnnaacgtacgtacgncngttaccgtacgttacgtaacgtaacggaacgtaaccgtaccgtacgtacctaacgtacgtaacgtaacgtaacgtacgaaccgtacgctnaaacccgaacggacgtacggtacccgttacgtacgtacctcgtacgacctacgtacgtacg

SEQ ID NO: 59660 - DNA, 599 bp, Homo sapiens
  misc_feature: GYAE6OF01A8X4Z.26.57.F02.1.454.CMB.1.raw
  modified_base (314)..(314): a, c, t, g, unknown or other
  misc_feature (314)..(314): n is a, c, g, or t
  modified_base (395)..(395): a, c, t, g, unknown or other
  misc_feature (395)..(395): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggaggtccgggggaggcgttggtccgaggcccgggggggtccctaggaaacctctcatgtgcaggctcgtggattcacattcagtgactcggctatatactgggtccnccagtctggaccgggaagggctgggagtggcgttggaccgttagttagaacccaaacctgacaaagtcgacgacaatttangctgcgtcggtgcgaaggcaggttcaccatcctccagagatgagtcagaagaacgacggcgtatctacgactaaagtacgaacacggtaccgtaacggaaaacccggacgaccgaaccggtccgtagttacgttacgtggtcgaccgacgctaccttccggttacttacgtttacgttaactttttctacggttcggttacccg

SEQ ID NO: 59661 - DNA, 777 bp, Homo sapiens
  misc_feature: GYAE6OF01C1S7N.26.57.F02.1.454.CMB.1.raw
  modified_base (605)..(605): a, c, t, g, unknown or other
  misc_feature (605)..(605): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttgggctgagcttgggttttccttgttgacttaagttttaaaaggtgtccagtgtcaggtgcagctgggtggagggtccgggggagtcgttggtccgacgggcccggggggtccctagaaactcgtcatgtgcgaggctcgtaggacttacaactatttcagtacgactcggacttaatagttaccgtcgggtcccgacctagtccgtcgggacccggggaaagggtccgttagggacggttcggtcgttacgggtacccgttaagtttaaaccgaaaacccgtaaaccgtcggaaaacgtaaacggtaacccggaacgtaacctttaaaagttttcgtacggtccgttcgggtcgttccggggtacgacggtaaacgggtcgtacggttaccaaccgtaactccgtaccgaagtagagtacgtattacgaaagaacgtaaacgaccggtacgttaacgtcgtaanaacggtaaagtaacggaaaccgaaccggtaaccggtaaccgggaaaaaccggtacgggaaccgtaaccgggttaccgttagttaccgttactcggtaccgacctaacggacttaccggttcccgtttacgtttaactttacgttttattttccggacggttccgttaacccg

SEQ ID NO: 59662 - DNA, 766 bp, Homo sapiens
  misc_feature: GYAE6OF01CE4D1.26.57.F02.1.454.CMB.1.raw
  modified_base (615)..(615): a, c, t, g, unknown or other
  misc_feature (615)..(615): n is a, c, g, or t
  modified_base (752)..(752): a, c, t, g, unknown or other
  misc_feature (752)..(752): n is a, c, g, or t
tcagagactatactcacgaccggtgctcgatttagctcgatatagttgggtttggggctgggagaggagctccagccttgggattcccagctgtcctccactcggtgatccggcactgaatacaagagactcaccagtggagtttgggctgagtcgttgggttttccttagttgtactttaaagtttttaaaaaggtgtaccgtagtgtacgtaggtgcgagtcgtgggtgggaagggtccgggggagtcgttcgggtaccgacggggtcccggggggtccctaacggtaaacctctacgtagtggtggacgacggtccgtgtacggtacttcaaactgttaccgagtgtaaccgtcggtacttaagtacggttaccgtccgggtcccgacctacggtcgacggggaaccgggtaagggtcgtgggtaggtcggtccggttacggtacgttaacgttaaaccgaaaccgtaaccgtaaggaaccgtaaacggacggaactaactttaagttcgtacgccgttagcggtcggtacgaccggtaaggtccgtaggtacccagttactcctaagagtaatcggtacgtataccgaagtaccgaacgtacgtcgttaanaccgtagaaacgtaagacgtaaaccgcgtaaacccggtaaggaacccgtaacggtccgtaccgtaggtttcgaaatttcggacgtaaccgagtaccggacttaccgtacttaacgttacttcgtttatttacccggngttcccgtaacggg

SEQ ID NO: 59663 - DNA, 746 bp, Homo sapiens
  misc_feature: GYAE6OF01ALV2B.26.57.F02.1.454.CMB.1.raw
tcagagactatactcacgaccggtgctcgatttagctcgatatagttgggtttggggcgtgggagaggagctccagccttgggattcccagctgtctccactcggtgatcggcactgaatacaagagactcaccatggagtttggctgagtcttgggttttccttgttgtcttaagttttaaaaggtgtccagtgtcgaggtgcgagctggtggacggtcggggagtcgttggtccgagggtcccggggggtacctaggtaacctctacgtagtcgtcgacgcggtcttcgtaggtaccttcaaccgttactcgaagtaccgtaccgtacggtccttaattacgttacggtccgggtaccgtccgtacggtcggtaccggggtaccggggaaaggtcggtacggtacgggtggtccgttcgggtaccgtttaacgtaacggaaacccttaacgacggaacgtaacgtaccgaagtaaccgttaaatttcggtacgacgttcggtaccgggttcggtaccgaacgggtaacgggcgttaaccgtaccgacccttaacgtccgtaaccgaagtacgtagttacgtactacggtaagaacgtaccgacgtactacgtagtaaccgaactaacgaacgtaaccacgtaccgaaacgaaccgtacggacgtaccgtacggtgttacctagtacgtcgccgttaacgctaccgtcgttaacgttacgttagttaccttttgagttccgtacg

SEQ ID NO: 59664 - DNA, 718 bp, Homo sapiens
  misc_feature: GYAE6OF01A8OJ3.26.57.F02.1.454.CMB.1.raw
  modified_base (152)..(152): a, c, t, g, unknown or other
  misc_feature (152)..(152): n is a, c, g, or t
  modified_base (479)..(479): a, c, t, g, unknown or other
  misc_feature (479)..(479): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctaaagngcttgggttttccttgttgcttaattttaaaaggtgtccagtgtcaggtgcagcgtgggtgggagggtccggggggaggtcgttcgggtccgacggggtcccgggggggtccctaggaaacctctacgagtggcgcgacggcttcgtggacttaccgactattcgagtgacgtccggtacttatacttaccgtcggggtcccgccgtaggtccgtcggaaccgggggtaaagggtcgtagggaggttcgggtcgtttcggggtaccgttaagtttaacggaaaaccctaaacgtcggaaacaacggtaccgacgtaactaagtttancggtctggtccgtgggtacgacgtaagggcctaacgggttaccaaccgtactacctaccgaagacgtacgttagtacttacggaagaacgaacggacggtactatctacggaataaacgtagaaccacgtaccgaaacgaaaccggacgacgtaccgacggttatttaacgtacgtgccgactacgtcgaccgttccgtacgtttaacgttacgttttatttcggacgttcggtacccg

SEQ ID NO: 59665 - DNA, 947 bp, Homo sapiens
  misc_feature: GYAE6OF01CL39S.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacagagactcacatggagtttggctgagcttgggttttcttgttgcttattttaaaaggtgtccagtgtcaggtgcagcgtgggtgggtacgggtccggggggagtcgttcggtccggacggggtcccggggggggttaccctaggtaaaaccgtcgtacgtagttcggtcggtcgagggtccttacgttagggtaactttaccgaacttacgttacgtaggttacgtaccgttcggtaccttaagttacgttaaccggttcggggtccccgaccgtacggttaccggtaccggggaaccgggggaacggtccggtaggggtacggttcgggttacgtttaccgggtaccgttaaacgttaaccgaaaaacccgtaaaccggttcgtaaaacgtaaacggtaccggtaaccgttaaacttaaagttttacgtaggtcccgttacgggttacccgggttacggtcggtaaccggtaacgggtcggtaaccggttacccaacgttaccgtaccgttaaccgaagttaacggtaagttacggttaacttacgggaaacggtaacggtaaacccggtacgggttaccgttaacgttaacgtaaccggtaaacgttaaacgtaaccgggtaaacgtaacccggtaacggtaaaacccgggtaaaccgggtaaccggtaacccgggtaaccgggttaccgttacggttaaaccgttcgggttacccggtaccgttaacccggaaacgttccggttacccgtttaaccggtttacgtttaaaccgtttttaccggtttaacgtttttccggaccgggttttaccggtaacccggg

SEQ ID NO: 59666 - DNA, 732 bp, Homo sapiens
  misc_feature: GYAE6OF01CRODR.26.57.F02.1.454.CMB.1.raw
  modified_base (126)..(126): a, c, t, g, unknown or other
  misc_feature (126)..(126): n is a, c, g, or t
  modified_base (212)..(212): a, c, t, g, unknown or other
  misc_feature (212)..(212): n is a, c, g, or t
  modified_base (559)..(559): a, c, t, g, unknown or other
  misc_feature (559)..(559): n is a, c, g, or t
  modified_base (625)..(625): a, c, t, g, unknown or other
  misc_feature (625)..(625): n is a, c, g, or t
  modified_base (682)..(682): a, c, t, g, unknown or other
  misc_feature (682)..(682): n is a, c, g, or t
  modified_base (714)..(714): a, c, t, g, unknown or other
  misc_feature (714)..(714): n is a, c, g, or t
tcagagactatactcacgaccggtgctcgatttagctcgatatagttgggttggggctgggagaggagctccagccttgggattcccagctgtctccactcggtgatcggcaactgaatacaaganactcaccatgggtagtttgggctaggacgtcgttcgggttttccttgttgtacttaagttttaaaaggtcgtaccagtgtcaggtncgagtcgtgggtaggagggtccgggggagtcgttcggtccgacggggtcccggggggtcctaagaaactcgtcgtagtggtcgacgaggtcctcgtacggtattaccactagttacaggtacgtacccgtaggaacttagtaacgtcggttaccgggaccccgtacgtacggttaccgaacgggggaacccggggtaaaagggtcggttagggtaacggtcgggtttaccggtaccgggtaaccttaaaggttaaaacccgaaaccgtaaaccgtacgaacgtaaacggtaccgaaaccgtaattaaacttcgtcgtacgttacggcggtacggtgaacgtaacggntaaccggtacaccgtactacacgtaaggctacgtagactagaacgaagtaacgagtactatacganaactaagacaacgtacgacgtaacgaacgacgacgagtacgtagtatacgtcgacanacgacttaccgtacggttattacttaacgttntttacgagttcgtaaacg

SEQ ID NO: 59667 - DNA, 878 bp, Homo sapiens
  misc_feature: GYAE6OF01CWODK.26.57.F02.1.454.CMB.1.raw
tcagagactatactcacgaccggtgctcgatttagctcgatatagttgggtttggggctgggagaggagctccagccttgggattcccagctgtctccactcggtgatcggcactagaatacgaagagactcaccagtggtaggtttgggctggacgtcgtttcgggtttttccttgttgtacttaaagtttttaaaaggtgtacctagtgtcgaggtgacagtcgtgggtagggaggggtccggggggtaggtcgttcgggtaccggaccgggggtcccgggggggttacccctaacggtaaaccgtccgtacgtaaggttggtacggacggtacggtcggttcgtacggttaacttaccgtactaactttaccgtaaggttacggttaccgtacggtacttaacgttaccggtaccggttccggggttaccccgaccggtacggttccggtacgggggaaccgggggtaaacgggtcggtagggtacggttcgggtacgggttacggtaacgttaaacggttaaaaccgaaaccgtaaaccgtaacggtaaacgaaaccggtaacgtaacgtaaactttaaacgtttacgtacggtacggttcggtacgggtaggtaccgaaacggtagggtaccgtaacgttaccaacgttctccgtaacgagtacgtattacgataacggagaacgacggtacgtagtaccttagagtaaactaagaccgaacgaacgtaaccgaaacggaacggtacggaaccgttacggtactttacgtaccggttacgaccggtaacgaccgaccgttaacgttaccgttttaccggttaactttacggttttaacgtttccgtaaccggtcgggttaacccgttaacggg

SEQ ID NO: 59668 - DNA, 769 bp, Homo sapiens
  misc_feature: GYAE6OF01BM0Q5.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagcgttggttttccttgttgacttaagttttaaaaggtgtccgagtgtcgaggtgcagtcgtgggtgggacggtccgggggaggtcgttcgggtccgacggggtcccgggggggtaccctaggaaaccttcgtacagtggtgcgaggcttgaggtattcacgtattcgagtcgtacgtcggtatacgtagtacggtccgggtccacgacgtccgtacgggaccgggaaaggcgtagggagtcggtcgttacggacccgttaataacccgaaacctaacgtagaaccgtaaacgtacgacgtaactaacgtttagcgtacgttcggtcggtacggtacgaacgtaacgggtaccgtacgggttaccctaccgtaacgtttccccggaaacgacggtaagaagtttacgaaacgttcgaaaggtaaccggaacgttaccggacttaacgtacgtaaccgtaacgtaaaagtaaccgaaccggtaaaccgtaccggtaaaaccgggaaaaccgtaccgggaaccggttacggtaccgttagttaccgttacggtacggacgtacgaacgtaccgtacgttaccgttacgttacgtttactttagttacggtacgtcgttaaccgg

SEQ ID NO: 59669 - DNA, 860 bp, Homo sapiens
  misc_feature: GYAE6OF01AL3T0.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcaggcgtggtgggaggtccggggggaggtcgttggtcccgaggggcccgggggggtccctaggaacctctcgatgtgcgaggctcgtggtattcacgattcagtcgtactcggctatagtacgtcgggtccacgtaggtctcggaccggggaaacgggtcgtacggggaggtcgggttacgttcgggtaccgttaagtttacggaaaaccctaaaccgttcggaaacctaaacgggtcgaaccgtaagtaacgttttaacgtcggacgtttacggcgggtttacggtacggaccggtaagggtaccgtaccggtttaccgtaacccgtaccgttaccgttaacccgagggtaacggtaacggtaacgttaaccgttaaccgaaggaacggtaaacccgtaaccgggtaccgttaccgtttacgtaccggtaaacgttaaacgttaaccggaaaacgtaaccggttaaccccggttaaaacgggaaaaaccccgggaaaccgggtaccggtaaacccggggtcccggttaacggtttaaacgttaacccggttaggtacccggtaactaaacccgggtctaaccccggttccgtttaaccgggtttaaccgttttaacccgtttacggttttttaccccggtaagttcccggttaaccccggg

SEQ ID NO: 59670 - DNA, 972 bp, Homo sapiens
  misc_feature: GYAE6OF01E117X.26.57.F02.1.454.CMB.1.raw
  modified_base (211)..(211): a, c, t, g, unknown or other
  misc_feature (211)..(211): n is a, c, g, or t
  modified_base (954)..(954): a, c, t, g, unknown or other
  misc_feature (954)..(954): n is a, c, g, or t
tcagagactatactcacgaccggtgctcgatttagctcgatatagttgggtttggggctgggagaggagctccagccttgggattcccagctgtctcactcggtgatcggcactgaatacagagactcacatggagtttgggctgagtcgttgggttttccttgttagtacttaagttttaaaaggtgtccgagttcgtacgtaggtgacnggtgtacgggttagggacgggtaccgggggagtccgttcggtacccgtacgggggtcccgggggggttaccctaggtaaacctccgtacgtaggttcggtacgaccggtacggtccgttccggtaggtacttttaccgaaacttacgtttaccgaggttaccgtaccgttccgggtacttaacgttacgttaccggtaccgggtccccgtaccgttaacggttcgggtaccgggaaccgggggtaaacgggtccgtggggtacgttacgggttacggtttccgggtaaccgtttaaggttaaacccgaaaacccgtaaaccgttaggaaaacccggtaaacgttacccggaacgtaaacctttaagtttacgtcggttaaccgttcgggtaccgggttaccggtagtaacccgggtaacgggtacccggttaacgggttaccctaaccgtaccgtttaacgacccggtaaagggttaaacgacggttttaacgtaaccggttaagtaaccggaaaacggttaaccggtaaccgttaccggtttaaacgccggttaacggtaaacgttaaacgtaaccgggtaaacccgtaaccgggtaaacccggttaaaaccggaaacccggtaaaccggtaccgggtaaccggtaccggtttaaagttaaccgtaacgttacggtaaccggaacttacgtaccgttaccggtttaccgttaaacgtttatttaaccgtttagttttaccgngggttaccccgttaacgg

SEQ ID NO: 59671 - DNA, 944 bp, Homo sapiens
  misc_feature: GYAE6OF01EII90.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtagtttggctgagtcgttggttttccttgttcgtacttaagttttaaaacggtgtacctaggtgtacgtaggtgcgagtcgtgggtaggacgggtccggggagtcgttggtacccgaacggggtcccgggggtacctaggtaaacctcgtacgagtggtacgacgacggtcttcgtaggtacttaccaatacgtttacgaggtacgtaccgtacggtactaaacgtacgtaccgggtacggtcccggtacgaacggtcggttacgggaaccggggtaaggtccgtagggacgtttcgggtaccgtttacgggtaccgtttaaaacggttaaaccgaaacccgtaaaccgtaacggtaaacgtaaaccgggtaacggtaacccttaaacgtttaaagtttacggtacggtaccgttagggtacccgggttaacgggtacgtaaaccgggtaacgggtacgttaaccggttaccctaaccgttaaccgttaccgtaaaccgtaaggtaacgttaaggttagtaaacccggtttaagaaacggtaaaccggaaacggttaacccggttacgtaaccgttacgtacgaaacgttaaacgacggttaaaaccgaaccgtaaacccggtaaaaacgggaacccggtaacggtaaacccgggtaaccggttaacggttacgtttaaacgttaccggtaaccggtaccgaaaccgttaacggtaaacccgttacccgggtttacgtaaacccggtttttaaattttaacggttttaacggtttttaacccggtacgggttacccggttaaaccgg

SEQ ID NO: 59672 - DNA, 1046 bp, Homo sapiens
  misc_feature: GYAE6OF01CA4YL.26.57.F02.1.454.CMB.1.raw
tcagagactatactcacgaccggtgctcgatttagctcgatatagttgggtttggggcgtgggagaggagctccagccttgggattcccagctgtctccactcggtgatcggcactgaatacaagagactcaccatggagttgggctgagtctgggttttccttgttgtcttaagttttaaaaggtgtccagtcgtcaggtcgcgagtcgtggtgggacggtaccggggggaggtcgttcgggttacccgacggggtccccggggggggttaccctaggtaaaaccgttccgtacctacgttaggtacggtaccgtagggtccgtttccggttacgggtaactttaccggtaaacctaacgtttaccggtaacgggttaccggttaacccgttaacccggggtaccttttaaacggtttaaccgtttaaacccggggttacccggggggtttccccggtaaccccggttaacgggtttacccggtttacccggggggaaacccgggggggtaaaaccggggggttcccgtttagggggtaaaccgggttcgggggtttccccggttttaacgggggaccccggttttaaacgttaaaacccgggtaaaaccccgtaaaaacccggtttacggaaaccggttaaaacgggttaacccggtaaacgtttaaacccgttaaaacggttttacgtccggtaacggttcgggtaccgggttacgggtacggaaaccggtaacgggttccgtaacgggttaaccctacccgtattacccccggttacgtaaaggggtaacttaacggtacggtttaaccgttacccggaaaggtaaaccggtaaaccgggaccgggttttactaaacgttccgaaagtaactaaacggtacgaaaaccgtacccgggttacaaaacggggtaaaccgaccggtaaccggaccgtttcggtaaaccttagttaccggaacgttacgggccctaaaggggtcccttagttacccggttactttacggtttaacttttaggtttcccgtagggttccgtacccgg

SEQ ID NO: 59673 - DNA, 661 bp, Homo sapiens
  misc_feature: GYAE6OF01EB3M0.26.57.F02.1.454.CMB.1.raw
  modified_base (429)..(429): a, c, t, g, unknown or other
  misc_feature (429)..(429): n is a, c, g, or t
  modified_base (484)..(484): a, c, t, g, unknown or other
  misc_feature (484)..(484): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
tcagagactatactcacgaccggtgctcgatttagctcgatatagttgggtttggggctgggagaggagctccagccttgggattcccagctgtctccactcggtgatcggcactgaatacaagagactcacatggagttggctgagtctggtttccttgttgtctaattttaaaaggtgtccagtgtcgaggtgcgagtcgtgggtgggtacgggtccgggggaggtcggttcggtaccgaccgggggtcccggggggttaccctacgtaaccgttccgtacgtagtgtcggcgaggtccttcgtaggtacttacgactacttacgtagtcgacgtcggtacttacgtaacgttacggttccggttccgaccgtcgttacgggtacggaccgggtagggacgtggtagtggtccgttaggtaccgttnaaacgtaacgaaccaacgtagaacgtagtacacgtacgtatgtcgcgtgcgtagngacgtagtctacgtcactacncanagatagtatacacgaagtacgacgtacgtntacganacgtacgtaagtacgacgacgaacgtaacgaaccgacgtaccgtcggtacgttagtacgtcgtacgtacgactaccgtacgtacgttcgtacgttacgttatttcgttcgtcggtcg

SEQ ID NO: 59674 - DNA, 853 bp, Homo sapiens
  misc_feature: GYAE6OF01C0Z45.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggagtttggctgagtcgttggttttcttgttgtacttaagttttaaaggtcgtcctagtgtcgaggtgacagtcgtgggtggacggggtccggggagtcggttcggtccggtaccggggtcccggggggtaccctaacgtaaccgttccgtacgagtcggtcgacgcggtcgtacgttaggtcttaacctacgttacgttaccgagtacgtaccgtacggtacttagttaccgtcggtacggtaccgaccgtacggtccggtacgggaaccgggtaggcgtagggtcgttacggtcgttaccggtacgttaaacgttaaccgaaacctaaccgtacgtaaacgtacgtaaccgaacgttaacttaacgttagtccgtcgtaccggtcggtacggagtaccgtacggtcgtaacgttaacccgaccgtactaccgtaacgagtacggtaattaacggtactaaccggagtaaacccggtaaccggtacggttaccgttacgtacgtaacgaaacgtaaccgtaacgtaacggaaaccgtaaccggtaaaccgggaaaccggtacccggtaaccggtaaccgggttacctttaacggtaaccggttacggtacgtccggtaacccttaacggtaacccgtttaccgttaaacggttacccttttaacggttttaaacgtttccgtttttaaaccgaccgggtttacccggttaacccgg

SEQ ID NO: 59675 - DNA, 871 bp, Homo sapiens
  misc_feature: GYAE6OF01DAB0L.26.57.F02.1.454.CMB.1.raw
  modified_base (303)..(303): a, c, t, g, unknown or other
  misc_feature (303)..(303): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggaggtttggctgagtcgttgggttttccttgttgcttaagttttaaaaggtcgtccagtgtcgaggtgcgagcgtgggtggagggtccgggggagtcgttcgggcccgacggggcccggggggtccctagaaaactcgtactgtgtgcgaggctcgtgtattcactnttacgagtgaaccgtgactatacgtacgtggtcccgtcgacgtcgtacggaaccggggtaaagggccgtaggggtacggtcgtcgtttcgggtaccggttagtaaaaccgtaacccgtaaaacgtacggtaaacgtaaacgggtaaaccgtaaccggtaaactttaaacgttttaaacgtggtttaccccggtcggttacccggggtttaaccggtacgggtaaccgtaaacgggggtacccggttaaacccgggtttacccccgtaacccttaacccgttaacccgtacccgtaaaacggaacggttaaggttaacgtaacggttttaaccgaagggtaaaaccgggtaaccggtaaccgggttacgttaacggtaccgttaaacgtaacgtaaaacgttaaccgaaaacccgtacggtaacccgttaaaccggaaaacccgggtaaccggtaaccgtaacccgggtaccggttaggttacgtaagtcggtacgacgtacgaccgttacgttaacccggttacttaaggtttaccgtttaacgttttacggtaggttccggttaccg

SEQ ID NO: 59676 - DNA, 742 bp, Homo sapiens
  misc_feature: GYAE6OF01ATBRS.26.57.F02.1.454.CMB.1.raw
tcagagactatactcacgaccggtgctcgatttagctcgatatagttggtttggggctggagaggagctccagccttggattcccagcctgtctccactcgtcgatcgcactgatacaagagactcacccatcggagtttgggctgagctggtttcctcgttgctattttaaaggtgtcctagtgtcacggtgcagctcggtgagtccggggagcttggcgacgccgggggtcctagaaactcgtcattgcgctacgctctggacttcgactattacaagttagaccgtcggactatacgttactgggtacccgtaccgtaacgttccgacgtaccggggaaacggtccgtgggtaacgtccgggtccgttacgggtacccgttaagtaaacggtaaacccctaaaccgttcgaaacgtaacggtaaccgcggtaacctaagtttcgtcgtcgtcgtcggtcgtacgcgaacggtctacggtccacactctaccacgtagacttaggtaacttacgacgtaaacggtaaccgaccggtacggttaacttccgtaagtaaccggttaaatacgggtaaactacccggtaaccggttaacggaaaacgggtaccgaaccggaacggttccggtagttaaccgttacggttaccggtacgtacccggtagtaacccgtaccggttcccggttacgtttaacggttaccctttagttttcccgaacggttcccggtttaaccccgg

SEQ ID NO: 59677 - DNA, 671 bp, Homo sapiens
  misc_feature: GYAE6OF01A1O6S.26.57.F02.1.454.CMB.1.raw
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (187)..(188): a, c, t, g, unknown or other
  misc_feature (187)..(188): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtagctattaaagngcatntnagtcnngctgtgagtcgggngntgtcaggccgggggtcctagaactntcgatcgtagcaggtctgagtattacgatcttgagttagaccgtggtactaataccgtaggtcgggtccaactaggtacccgtacggtaacggggaaggtcggtaggtaggtacgtcgttcggaccgttaatacggaaaacccaacgtacggtaaacgaacgtacgcgtaaacttaagtttcggactcggttacggacgtaccggtagacggtaacggtgtaaaccggttccaaacggttaccacctagacgtaaggacttagactagagtacaacggacgtaacgtagtagtataacgaacgtacacgaacggtaaccgaagtaacccggaagaccgaacggtacgttacgaagttaccggtaacgttcgaacgtacgtacgtaccgttaacgttacttaaacggtttagtttaacgtttacgaagggtttcccctaaggg

SEQ ID NO: 59678 - DNA, 874 bp, Homo sapiens
  misc_feature: GYAE6OF01D0PBC.26.57.F02.1.454.CMB.1.raw
tcagagactatactcacgaccggtgctcgatttagctcgatatagttgggtttggggctgggagaggagctccagccttgggattcccagctgtctccactcggtgatcggcactagaatacaagagactcaccgatgggtggtttgggctggagtcgtttcgggtttttccttaggttcgtactttaaagttttaaaaggtcgtaccgagttcgtcagggtgcgagcgtggggtggagggtccggggagtcgttcggtccggacggggtcccgggggtaccctagtaaacctctacgtagtcgtcgcggacgtcgtcgttaggacttacacgttatacgaggttgaacgtcgtactaagtacgtacggtccgggtaccgccgtaggtaccgtacgggaccggggtaaacgggtcggtagggacgttgggtccgttacgggtaacctttaaagaacccgtaaacctaacgtacggaaacctaaacggtacgaacgttaaataaacgttgacggttcgaccgggtcgtacgggacgtaacggtaacgtaccgtacgttaacccgaacgttaccgtaccgtaaaccgtaggtaagttaccgtaagtaacgttaacggaacgtaaacggtaacccgtaacgggtaccgtaacgtactaaccggtaacgtaaaacgtaaccggaaaccgtaaccggtaaaaccccggtaaaacgggaaaacggtaccggtaacccggtaaccggttccggttaaagttaaccggttaaccgtacggaaccgtaaccgtaaccggtaccgttaacccggttaccgtttaacggtttaacgtttaaccgtttttaagtttaacccgggttaggtacccggttaaaccggg

SEQ ID NO: 59679 - DNA, 754 bp, Homo sapiens
  misc_feature: GYAE6OF01BLZ3U.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggagtttgggctgagcgttgggttttccttgttgacttaagttttaaaaggtgtccgagtgtcgaggtgctagcgtgggtgggacgggtaccggggggaggtcgttcgggtcccgacggggtcccgggggggtcctaggtaaacctctacgagtggtgacgaggtctccgtaggtactaccaactacttacgagttcgacgtcggtacttagtacgtacggtcgggtccgacgtagtccggtacggaccgggaagggtcgtagggtaggtcggtcgttcgggaccttaagtaacgaacccgtaaacgtcgtaaagtaacgtacgacgtaacttaagtttacgacgcgtacggtcggttcggacgtacgaagggtacctacggttacccgacctagtccgtaccgaaggtagtaacgtagtagtacgaggaaaccgaacgacgtagtactcgtaacggaataacggaacgaaccgtacgtaacccgaaaccggaaacgggacggacccgaaccggttccggtaagttaccttacgtaccggaccgtacggaacgtccgtacgttacccggttgtttaaaccgtttacgtttaacgttttcgaagggtcccgttaaccgg

SEQ ID NO: 59680 - DNA, 868 bp, Homo sapiens
  misc_feature: GYAE6OF01ETIIH.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactacacatggtaggtttggctggagtccgtttgggtttttcctttgttggtactttaagtttttaaaagggtgttaccgtaggttggtcgagggttcgccgaggtcgttggggtagggtacggggtccggggggtacggttcggttcgggtaccggaccgggggtcccgggggggtacccttacggtaaccttctaccgtagttcggcgtcggtacggtccttacggttggtactttccaacttatttccgaggttactacgtaccggtacttagttaccgttacgggtcccgggttacccgaccgtacggttccggtaccggggacgggggtaaacgggcggttaggggtggtttcgggtcggtttacggtaacccgtttaaagttaaccgtaaaacccgtaacgttaacggaaccgaacggttaaccgaacgtaactagttacggtcgtacgtcgggtaccgggtgcgaacgtacgtacggtacgtacctactacgtccgtacaaggtaacgtacttacggactgaaacggtaccgtaacggtaccgtaacgttcgtaactacgaaacgtaacgtaaccggaaccgacggtaaaccgtaacggggaaaacgtacgggtaccggacgggttacttacggtaagtttaaccgtacgggaccgtaacttacggaacccggtttcgtacgtttaccgtttaactttacggttttacgttacccgtttggggtcccttaacggg

SEQ ID NO: 59681 - DNA, 690 bp, Homo sapiens
  misc_feature: GYAE6OF01BXFTA.26.57.F02.1.454.CMB.1.raw
  modified_base (107)..(107): a, c, t, g, unknown or other
  misc_feature (107)..(107): n is a, c, g, or t
  modified_base (126)..(126): a, c, t, g, unknown or other
  misc_feature (126)..(126): n is a, c, g, or t
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (402)..(402): a, c, t, g, unknown or other
  misc_feature (402)..(402): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagagactatactcacgaccggtgctcgatttagctcgatatagttgggtttgggctgggagaggagctccaggccttgggattcccagcctgtctccactcggtnatcggcactgatacaaganactcacagtcgtagttgggcttggagcgtttggttttccttagttgacttaattttaaaacggnttacccaggttcggtcagggttncgaacgtcggttgggtacgggtacgggtcccgggggtaggtcgtttaccgggtccggaccgggggccccgggggggttaccctaacggtaaaccgtccgtacctaagttcgtggcgttcggcttacgtcggtactcgaacttacgtcgagtcgtacgtcgtactaagtacgtaccggttcgggaccccncgtagttcggaacgggtacgggaggcgttgggacgttggtcgttaggtcgtaacttaccaaccgaacgtggaacgtagcgacctaatacggtngcgtcgngagtcacgtgctacgtctctactctacgacgaagtcgtatcgagtacgaaggaacgacgacgtgtacataacgaacagaaccgtataccggtaacgtacgaacgaggttaccgcggtactcgttacgtcgtcgtaccgactaccgtacgtcgttacgttatttaccgttagtacttcgtcgttaccgg

SEQ ID NO: 59682 - DNA, 839 bp, Homo sapiens
  misc_feature: GYAE6OF01B0JND.26.57.F02.1.454.CMB.1.raw
  modified_base (568)..(568): a, c, t, g, unknown or other
  misc_feature (568)..(568): n is a, c, g, or t
tcagagactatactcacgaccggtgctcgatttagctcgatatagttgggtttggggctgggagaggagctccagccttgggattcccagctgtctccactcggtgatcggcactgaatacaagagactcacagtggtagtttgggctgacgtcgttgggttttccttgttgtactttaaagtttttaaaagggtcgttaccgtagttggtacgagggtcgcgaggcgttgggtacgggtacgggttcccggggggagttccggtttcgggtacccggtaccggggggtccccggggggttacccctaaaggtaaccttccgttacgtagtaggtcggacgacggtcgtcgtaggtacttacgtactaagttcgaaggtcgtaacgtcggattaatacgtacggtccggtccgacgtacggttacggacgggaaccggggtaagggcgttagggtcggtacggttaccggtgggttaacctagttaaaccgaaaaccgtaaccgtagtaaaccaacggtacctacgtaactttaagttacgcgtacggtcgacggttcggtagaccgnggtacacggttacactcgctaacgacgtagattaacgagtaacgaacgacgtaaccggagttcccgtaagttacaaccggtaaacgtaaccgaataaacccgggaactaaccggttaaaaccggaaccggaaccgtaacgggtcccggttaagttaacgttagtaccggttaaacgaccgtaaggacccttaaccgtacccgtttaacgtttacccgttttaaaggttttacggtttaccgtttaccgtacggggtaccccgttaaacggg

SEQ ID NO: 59683 - DNA, 570 bp, Homo sapiens
  misc_feature: GYAE6OF01D1SOB.26.57.F02.1.454.CMB.1.raw
  modified_base (278)..(278): a, c, t, g, unknown or other
  misc_feature (278)..(278): n is a, c, g, or t
  modified_base (363)..(363): a, c, t, g, unknown or other
  misc_feature (363)..(363): n is a, c, g, or t
  modified_base (382)..(383): a, c, t, g, unknown or other
  misc_feature (382)..(383): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggtcgttggtccgaggcccgggggggtccctgaaacgtctcatgtgcaggctctggattnacattcagtcgactcggtctatatacgtgggtccgcctagcgtcggaccgggaaggcgtggagtgcgtggctatacgaacaactnacaagtacgcgactaattnnctgcgtgnacagntacgtcactatcacaganatagtatacgagaacacgcgtactctgngaacaatacgaancgactaacgaaacgacgacgacggtctagtacgtcacgttcggagaccgacgtaacctcgtacccgttaaccgtttaacgtttacgttttaacgtttttcgaacgtttacccggg

SEQ ID NO: 59684 - DNA, 789 bp, Homo sapiens
  misc_feature: GYAE6OF01DQL82.26.57.F02.1.454.CMB.1.raw
tcagagactatactcacgaccggtgctcgatttagctcgatatagttgggtttggttctaatacggccaagccactccagccttgggattcccagctgtctccactcggtgatcggctactgaatacaagagactcacagtggtagtttggctagtagtcgttcggttttaccttggttagtcctttaagttttaaaacggtcgtacccgtagttcgtcgtaaggtgacgtagtcggtgggtagggtacggtccgggggtagtcgttccggccggtcggggtcccgggggtacctaggaacctctaccgagttggtcggtccgtacgttcgtaggtactacgtaacgtattaccggagccgtacgtacggtactattaccggtacggtccggacccgtctacgggtcgtcccgggtaaacggggtacggttacggtaggacggttcggtttaccgttacgggtaaccttaaacgtaaccgtaaacccaacggtacgtaaaccgtaggaaccgtacgtaacttagttacgcgtacgtcgtcggtacgtgaaacggtgtacgtacgtaccctagtacctcgtacgagtagtacgtaacgtactagaacgaggtaaaccgaccgtaccgtgttaaccgagtaaacgagtaaccgtagtaacccgtaacgtaaaccggaacggaacggtaaccgtccggtacgttagtaacgtacggtacgccgttaacgtaaccggtaagtccgttaaccgttacgttacttaacgttacgtttacgtggtaccgtaccggg

SEQ ID NO: 59685 - DNA, 829 bp, Homo sapiens
  misc_feature: GYAE6OF01EJ1EI.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggagtttggctgagtcgttgggttttccttgttgtacttaaagttttaaaaggtgtacctagtgtcgagggtgcaggtcgtgggtagggacggggtccgggggaggtcgttcgggtaccggacgggggtcccggggggggttaccctacggtaaaccgttccgtacgtagtggtcgcgtaggtccttcggttggtaacttcgaacttattaccgaggtaccgtacgtccggtacttaagtacgtaccggtacgggtcccgtaccgtacggtcggtacgggaccggggtaaacgggcggtagggtacggtggtcggttaggtaccgttaataaccggaaacctaaccgtagaaaccgagtaccgagtaacttaattacgcgtcgtcgggtacggtcgtacggtacggaacgtccggtaacggttaccaccgtacttacgacgtagaagtacgtagtacgtaacgtaaggaacgtaaaccgcgggtaactagtacgtacgaacgtaaacgtaacgtaaaccgacgggtaaacccggtaaacggaaacccggaacgggtaacccggtaaccgggtaaccggtttaacgttacgttaccgtacggtaccgacgtaacgtacccgttacccgtttaccgggttacgtttaaccgtttacgttttaacggtttccgttacggttccggttaacccgggg

SEQ ID NO: 59686 - DNA, 878 bp, Homo sapiens
  misc_feature: GYAE6OF01BVKHS.26.57.F02.1.454.CMB.1.raw
  modified_base (694)..(694): a, c, t, g, unknown or other
  misc_feature (694)..(694): n is a, c, g, or t
tcagagactatactcacgaccggtgctcgatttagctcgatataggttgggtttggggctgggagaggagctccagccttgggattcccagctgtctccactcggtgatcggcactgaatacagagactcaccatggagtttgggctgagcgttgggttttccttgttgtcttaagttttaaaggtgtccagtgtcaggtgcaggctggtcggaggtccgggggagtcgttggtccgacggggcccggggggtacctaggtaaaccttcgtacgtagtggtacgcgtacggtcttcgtaggtacttccactacgtttaccgaggttacgtaccgtcggtacttaagttactaccggtcgggttaccccgcgtacggtccgttcgggaaccgggggtaagggtcgtaggggtacgggttggtacccggtttacggtaccggttaacttaaccgggaaaccctaaaccggtcgtaaacgtaacggtaaccggtaaccgtaacgttaacgtttaagttccggtaccgttacgggtacccgggttacggttaccgggtaacggtaaccgggacgttaaccggggtttacccctaaacccggttacgttaccccgttaccgaaaggggttaacttaacgggtacgttaacggttaacccgaaaggtaaaccggttacccggaaccgggtttacccggtntttaacgtacccggtaaagtaaacgttaccggaaccctaaccgggttaacccgaaaaccgggtaaccgggaaccgttacgaaccggtccggtttaaatcctaacgggttcgacgtacccgagtacccgttacggttcccgttagttaaccgtttacttttaagtcgtacgggttccgtaaccgg

SEQ ID NO: 59687 - DNA, 839 bp, Homo sapiens
  misc_feature: GYAE6OF01CB77G.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgcttaattttaaaaggtgtccagtgtcaggtgcagctggtggaggtccgggggagtcgttcggtccgagggtcccggggggtcctagaaactctcgagtgtgcgacggtctcgtggtacttacgactagttcgtaaggttcgaacgttcggacttattacgtaccgtcgggtcccgtcgtacggttccgtacggaacccggggtaaagggtccgtagggtaggtcgggtcgttacggtaccgttaagttaaccgaaaccgaaaccgttacgaacgtaaacggtacgacgtaacgtaatttgtacgtcgtcggtacggtggtacggacgtaacggtccgtacggtttaccaaccgtacgttaccgaccgtaagtacgtagttaagtaccgttaacgaacggtaaacgtaaaccggtaacggtaccgttaacgtaccggttaacggtaactaaacggttaaccggtaaacccgaaccgggtaaacccgttaaaacccggaaaaaccggtaacccgggtaaaccggtacccgggttaaccgtttaacggttaaccgttaccggttaccggtaaccggtaaccaaacgggtaccttaaccggttacccgtttaacggtttaacgttttaacggttttaacgtttttacggtaaccggtttcccggttaaaccggg

SEQ ID NO: 59688 - DNA, 740 bp, Homo sapiens
  misc_feature: GYAE6OF01B6G70.26.57.F02.1.454.CMB.1.raw
  modified_base (393)..(393): a, c, t, g, unknown or other
  misc_feature (393)..(393): n is a, c, g, or t
  modified_base (423)..(423): a, c, t, g, unknown or other
  misc_feature (423)..(423): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttggttttccttgttgcttattttaaaaggtgtccagtgtcaggtgcagctgggtggaggtccgggggagcgttggccgacggggtcccggggggtccctagaacctctcagtgtgcgaggctcgtggtacttcactattcgagtcgactcggctatacgtacgtcgggtccaccgtagtcgtacggaccggggaaggcgtaggagtggtccgttggaccgttataaccggaaccaacgtnaacgaagtacgacgtaacttaagtttacgngtacgtggtcccggtggtacgacggaagggtccgtacggtcccaaccgtacttaccgtaccgaaggtaacgtacgtagtacgttacggaaacggaacggtaaaccggtaccggtacgtacgttcgtaacgtaacgtaaacgtaacgaacgtaacccggtaaccgaaaacgggaaacccggtaacggacccgtaaccgggtccgtttaaggtacgttaaccggttacgacggtacccaacggtaccgttaccggtttacccgttaacggtttaccttttacgtttaaccgttttacgacgggttacccggttaaccgg

SEQ ID NO: 59689 - DNA, 868 bp, Homo sapiens
  misc_feature: GYAE6OF01CHLQ5.26.57.F02.1.454.CMB.1.raw
  modified_base (315)..(315): a, c, t, g, unknown or other
  misc_feature (315)..(315): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtgggagtttgggcctggagtcgttgggtttttccttgtttgtacttaagtttttaaaagggtcgttcctaggtgtacgagggtgcagtcgtgggtgggacgggtccggggggagtcgttgggtcccgacggggtcccgggggggttccctaggtaaaccttctcgtagttcggtgacggngtctcgttagggtacttccaacgtagttccgaggttacgtacgttcggtattaactttacgtaaccggttcggggtccccgccgtaacgggttcctacggggaacccggggaagggtccggtagggtgggtaggtccggtttcggtaaccgttacgttaaacggaaacccaacggtagaacctaaggtccgaacgtaactatttagcgtcgtcgcggtaggtcgacgtaaggcgtacgtaccgactacgttaccacgaagaaggtatcgtagttaacgaacggttaacggaaaccggtaccggtaaggtaacgtcgtaacgaacgtaaacgtacgtaaacgtaaacccggggtaccttaaaaccgggaaaacccggaacggggtacccgtaacccggggtaaccgggttttacgttaaaccgtttaagggttaccggtaacggtaaccccgttaacgtaacccgtttaacccgttcgggttttaaaccgttttacggtttaaacccggttttttatttttaaccgggttaacggtttcccgggtttaaccccg

SEQ ID NO: 59690 - DNA, 804 bp, Homo sapiens
  misc_feature: GYAE6OF01D8II1.26.57.F02.1.454.CMB.1.raw
  modified_base (211)..(211): a, c, t, g, unknown or other
  misc_feature (211)..(211): n is a, c, g, or t
  modified_base (792)..(792): a, c, t, g, unknown or other
  misc_feature (792)..(792): n is a, c, g, or t
tcagagactatactcacgaccggtgctcgatttagctcgatatagttggggtttggggctgggagaggagctccagccttgggattcccagctgtcctcactcggtgatcggcactgaatacaagagactcaccagtggtagtttgggctggagtcgttgggttttccttgttgtacttaagttttaaaggtcgtccagtgtacgtaggtnacgagtcgtgggtgggacggtccgggggagtcgttcggtccggacggggtccgggggtacctagtaactcgtcgagtcgtgcacggtctgtggtatcagtgtcgtagtcgtacgtcggtatagtacgtacgttccgggctaccgtacgtccggtacgggaccggggtaaggtcgttacgggaggttcgtcggttccggtaaccggttaaattaaccccggaaaaccgtaacctagggaaaacctaaacgggtaccggtaccttaaagttaaaccgtttgaccggttacggttccggccgggtttacggacgtaacgggacggttaccgaaccggttacccaaaccgttcggttaacacccggaaggttaaccgagtttaacgaacgttcgaaaacgggttacgaaaccggtacccgggtttaacggttaccgaacgtaaacgaagttaccggaaaccggtcgtaacccgggttaaacgaacccggttaacggccgtaaacgggtcgttagttaaacctacggcggaaccttaggacccttaccgtggttaccgttagttacccggttattttacgggtacnggttacccggtg

SEQ ID NO: 59691 - DNA, 958 bp, Homo sapiens
  misc_feature: GYAE6OF01BZUDX.26.57.F02.1.454.CMB.1.raw
tcagagactatactcacgaccggtgctcgatttagctcgatatagttgggtttggggctgggagaggagctccagccttgggattcccagctgtctccactcggtgagtcggcactgaataacaagagactcaccagtggtagttggactgagtcgttcgggttttccttgttagtacgttaagttttaaaaggtcgtccgtagtcgtcgtaggttgcgaggtcgtggggtacgggtagggtccgggggagtcgttcggaccggacgggggtcccggggggtacctacggaaaccttcgtacgtacgtcggtcgaccggtacgggtccttaccggttagtaaccttacgtaacgttacgttacggtacggtaccggttaaccggtacgtaacgttaacggttaccggttaccgggttcccgggtacccgtaccggttaccgggttacggggaaccgggggtaaccgggggtaacggggttcgggttaacgggttacgggttcgggttaccggttaaccgggttaaccgttaaaacgttaaaacccgtaaaacccgtaaacggtacggtaaacgtaacggtaaccgtaacgttaaacgtttaacggttacgtaccggtacgtcgggttacgggtacggtacggtaacggtacggtaccggtaaccgttaccgtaaccgtaccgtacgtacgtaaggttacgtaacgtacgttaagacggaacgtaaccggtaacggtacgtacgttacggtaactaacggtaacgtaacggtaacgaaccggtaaccggtaaacggtaaaccggaaacggtaaccggtaccgggttaaccggtaccgtttaaacgttaccggttacgtacggtaaccgtaaccgttaacccggttacgtttaaccggttacccggtttaactttaaccggttttacgtttacgtttaccgggtaccgttacgggtaccg

SEQ ID NO: 59692 - DNA, 770 bp, Homo sapiens
  misc_feature: GYAE6OF01EINSC.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtaggtttgggctgagtcgttgggtttttcctttcgttagtacttaagttttaaaaggttgttccgtagttgtcgaggtgcgagtcgtgggtcgggacgggtccgggggaggtcgttcggtccgacgggtcccggggggtccctacggaaactctactagtgtcgcgacggtctcgtggtacttacactacgttacgacggttcgtaccgtcggtacttacgtacgttacggttccgggtcccgccgtacggtcggtacggggaaccggggtaagggtcgtacgggtaggttcggtcgtttacgggtaccgttaacgttaaccgaaaccctaacgtagtaaccgtaacgtacgacgtaacttaagtttcgtcgtacgtcggtacggtacggtcgacgtacggtacgtacggtaccaccgtactccgtacgaaggtacgtacgtatactaacgaaggtaacgaacgtacggtactactacgtacaagtaaacgtacgaaccgtaacgtaccgtaaacggaaaccggtaggaacccgtacggtacgttagttaccgttacgacgttacgaactacggtaacttaccgttccgttaacgtttacgttacgtttacgtttacgtcggttccggtacgg

SEQ ID NO: 59693 - DNA, 830 bp, Homo sapiens
  misc_feature: GYAE6OF01BQJIH.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcacctagtggtaggtttgggctggagtcgtttgggttttccttgttagtactttaaagtttttaaaacggtcggtcctaggttcgtacgaggtcgcgacggtcggttgggtcgggtaacgggtccggggggacggttcggttccgggtaccggtaccgggggtccccgggggggttaccccttaacgggtaaaacccttccggtacgtacggttcggtacggtcggtaacggtccgttacgtacgggttaccttacgtaaacttcgtttacgtacggttcggtaaccgtcgtaacgttagtttaccgtacgggttccggaccccgtaccggtaccgttcggtaaccggggacggggtaacggtcggtagggcgttacgggtcgttacgggttacggttaactaacgaaaccgtaaccgtagaacgtacgacgtagtaacttagttacgcgtcggttcgcggttacgagtacgacggtacgtacgtacacctcgtacacgtagactagtcacgtagaacgtacgtaaccgtacggtctagtaccgaagacgtaaccaacgaaccgtacgaaccggtaaccgaaacgggccgggtaacccagggtttaccgtagttacggtaacgtcgaaccgaccgtacggtactacggtttaccgtacgtttaacgtttccgtttaagtttccggtacgttcccgtaacgg

SEQ ID NO: 59694 - DNA, 931 bp, Homo sapiens
  misc_feature: GYAE6OF01DCL4F.26.57.F02.1.454.CMB.1.raw
  modified_base (126)..(126): a, c, t, g, unknown or other
  misc_feature (126)..(126): n is a, c, g, or t
tcagagactatactcacgaccggtgctcgatttagctcgatatagttgggtttggggctgggagaggagctccagccttgggattcccagctgtctccactcggtgatcggcactgaatacaaganactcaccatggtagttgggctgagtcgtttgggttttccttgttgtacttaagttttaaaggtgtccagtgtcgaggtgcgagcgtgggtggacggtccgggggagtcgttagggtccgtaggggcccggggggttacccagtaaacctctcgtagtcggtacgcgtacggtcctagttacggtacttaccgaactaactttcgaacgtttacggaaccgttcggtaacttaagttaaaccgtccggttaaccgggttcccgacccgtaaggttcccggtaaggggaaccccgggggtaaaggggtccgttaaggggttacggttaggggttccgttacgggttaaccgtaaaggttaaacccgaaaacccgtaaaccggtaacgaaacgtaaacgggtaacccggtaacgtaaaactttaaacgttttacgacgttaccgttacgggtaccggttacgggtacggtaaacggtaacgggttacgtaacggtaccgtaaccgtaccgttactaccggaaagtaagttaaacgttacgtaacgttacgtaaaccgggtaaacgtaaaccggtaccggtaactttaccgtacgtaacggtaactaaacggtaacgtaaaccggtaaccggaacccgtaaacgggaaacccgggaaccgaacgggttaaccgggtaccggtttaaacgttaccggttaccgtaacggaaccgtaccggtaacgttaacccggtaccgtttaccggtttaaaccgtttaccggtttttaacgtttaccggttttaacggtacgggttaccgttacgggg

SEQ ID NO: 59695 - DNA, 785 bp, Homo sapiens
  misc_feature: GYAE6OF01BBEBB.26.57.F02.1.454.CMB.1.raw
  modified_base (316)..(316): a, c, t, g, unknown or other
  misc_feature (316)..(316): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggagtttggctgagtcgttggtttttccttgttgtactttaagttttaaaaggtgtccgagtgtcgaggtcgcaggtcgtgggtgggacgggtccggggggagtcgttcggtaccggacggggtcccggggggtccctaggaaacctcgtacgtagtgcgcgacggtctcgtgtatcatntcgagtcgacgtcgtactagttacgtaccgtcggtccgaccgtacggttccggtcggaaccggggaaggtcggtaggtacggtacggtccgttacggtaccgttaagtaaccgaaaccgtacgtaacgaacgaacgtacgactaattaagttgtcgtacgtgcggttagcgacgacggtcgtacgtaccacgtctacgacgagtacgtgttactacgtacgaacgacgtaaccggtacgtacgtaacgtcgaacgtaataaccgaacgtaaaccgtaacggaaccggttaaaaccggaaccgggaccggtaaccgttacccgggtacgtttacggttaaacctaccgggttacgaaccccggtaacctaacggttacccctttaccgggttaccgtttttaaaccgtttaacggtttttaacccgttttacgggttttaccggtaaaccgggttccgttaaacccgggg

SEQ ID NO: 59696 - DNA, 801 bp, Homo sapiens
  misc_feature: GYAE6OF01A04AA.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggaggtccgggggaggcgttggtccgacgggtcccgggggggtaccctaggaaaccttcgtccagtgtcgcgaggtctcgtggtacttcgactattcgagtgacgtcggacttagtacgtaccgtcgggtcccgccgtaacgtccgtacgggacccggggaaagggtccgttggggacggttcgggtcgtttcggggtacccgttaagtttaacggaaaacccctaaaccgtacggtaaaccgtaaacggtaaccgaccgtaaacgttaaacgttttaagcgtacgttcggtacggtcggtacggtacgaaacggtcgtaacggttaccaccgtacttccgtaaccgaagtacgtaatacgtacgttacgaaggtaaacggaaccgtacgggtccggttaattacggtaacgtaaacgtaaacgtaacgaaaccggtacgtaaacccggtaacgggaaaaccggaacgggtaaccggaaccgggtccgttaacggttaaccgttacgttacggttccgaacctacggtaaccttaccggttacccgtttacgtttaacgttttacgtttactttttacggaccggtttcggtaacccgg

SEQ ID NO: 59697 - DNA, 781 bp, Homo sapiens
  misc_feature: GYAE6OF01D1L7I.26.57.F02.1.454.CMB.1.raw
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
tcagagactatactcacgaccggtgctcgatttagctcgatatagttgggtttggggctgggagaggagctccagccgttgggatcccgagctgtctccactcggtgatcggcactagaataacgaaggagactccgacagtaggtaggttcgggctgtacgtcgttcggttttccgttgttcgtacttaagttttaaaaggtcgtaccgtagttgtcgtaggtgacgaggtccggtgggtggggtacgggtccgggggcggttaccggttcggggtacccggtccgggggtccggggggttccccgtacggtaaacctcgtatcggttgcgcggtcggtccgttcgtggtacttaccgtacttactacgtacgttccgtacggtcgtacttacgttacgtcggttccggtcgcgtacggtcggacggacgggtacggcggtaggcgtcgtcgtcggactacgaacaacgtacgacgatacganacgtatatcgtgtacncggtacgtcgagtcgaacgactcggtacactagtacctcggactgtacgtatacgtaaggacgaacgtcggaacgttcaacgttactaggaacgaataaccgaacgtaccggaaacggtaaaccggtaaccggtacggtaccgtaacgggttaccttaggtttaaacctcgggttacggacctaaccggaacggtccccttaaccgggtttggtttaacccggttttaccggttttacgttttaccccggtttacgggttaaacggtccccggttaacggg

SEQ ID NO: 59698 - DNA, 838 bp, Homo sapiens
  misc_feature: GYAE6OF01CUNVC.26.57.F02.1.454.CMB.1.raw
  modified_base (771)..(771): a, c, t, g, unknown or other
  misc_feature (771)..(771): n is a, c, g, or t
  modified_base (779)..(779): a, c, t, g, unknown or other
  misc_feature (779)..(779): n is a, c, g, or t
tcagagactatactcacgaccggtgctcgatttagctcgatatagttgggtttggggctgggagaggagctccagcctgggattcccagctgtctccactcggtgatcggcactgaatacaagagactcaccagtggagtttgggctggacgtcgttgggttttccttggttcgtacttaaagttttaaaaggtcgtcccgtaagttcgtaccgtagggtgaccaggtcggttggggtagggtacgggtccggggggagtccgtttcggtacccggacgggggtaccccggggggtccctaaggtaaacccttcgttacgagttcggcgacgtacggtcgtacgtaggtacttacaccgtagttccgtaagtaccggtaccgtcggtaacttacgttacgtaacggttcccgggtcccggtaccgttacgggtaccggttacggggaaccccggggtaaagggtccgggttaggtaacgggttcgggttaccgttacgggttaacgttaaaccgtaaaccggaaaccctaaccggttacggaaacgtaaccggtacgaacgttaaacttaacgtttacgcggtccgttgggtccgttacgggtacgacggtaacggtcgttaccgggtaacctaacttacgtcctaacgagttacgtagttaccgtagtagaaccgtaaggaccgtagtaacttcgacgtaagacgttaacgaataccgacgtaccggaaaccgaacggaccgtacgtacggtattacgtacgtacggtanaccggtanacggttaccgttcttacgttacgttaacgtttactttcggtaacgggtttccgtaccgg

SEQ ID NO: 59699 - DNA, 608 bp, Homo sapiens
  misc_feature: GYAE6OF01EZY07.26.57.F02.1.454.CMB.1.raw
  modified_base (387)..(387): a, c, t, g, unknown or other
  misc_feature (387)..(387): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggaggcttggtccaggcccggggggttccctgaactctcatgtgcaggctctggattcacattcagtgactcggctatactactgggtaccgccagtctggccggggaaagggcctgggagtggcttggccgttatagaaccaaaccgtgacaagtacgcgactaatttangctgcgtcggtgcgtaaggctaggttcacctactctaccagagtatgacttcgagtacgaacgaccgggtacgtatcctagacaaagtacggaaacacgtaccgtaacggtaaaacccggaggaccgaccggtccgtagttacgttacgtacgtcggtaccacgacgtacgttacccgttacgttacttacgttaatttttcgtacggttcggttaccccg

SEQ ID NO: 59700 - DNA, 766 bp, Homo sapiens
  misc_feature: GYAE6OF01BNH6S.26.57.F02.1.454.CMB.1.raw
  modified_base (509)..(509): a, c, t, g, unknown or other
  misc_feature (509)..(509): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagttgggctgagtcttgggttttcctgttcgacttaagtttaaaaggtgtaccagtgtcgaggtcgcgagtcgtggtggtacggtccgggggagtcgttggtaccgacggggtcccggggggtcctagaaaccgttctaccgagtgtcgcgtacggtctcgtggtattacactactgtagtacgactcggatagtacgtaccgtcgggtccaccgtagttccggacgggtacccgggggaaggtccggtagggtacggttggtaccgtttacgggaccgttaacgtaacgaaacccgtaaccgtacgaaccgtaaacgtacggtaactaacttaagttcgtacgcgtcgtccggttggacgacgtacggtntaccggtccaacctcgtactacgaagtagagtacgtaacgtaacgaacggttaacgaaccgtacccggaagttctacgaacgaactaacggaacgaaccgtaacggtacgaaaccggtaaaccgtaccgggtaaccgaccggttaccggttattaacggttaccgtaccgtacgtacggaaccgtcggttacccgtaacccggtttaacttaccggtttaaccgttttattttaccggaaggttcccggttacccgg

SEQ ID NO: 59701 - DNA, 854 bp, Homo sapiens
  misc_feature: GYAE6OF01DH21S.26.57.F02.1.454.CMB.1.raw
  modified_base (211)..(211): a, c, t, g, unknown or other
  misc_feature (211)..(211): n is a, c, g, or t
tcagagactatactcacgaccggtgctcgatttagctcgatatagttgggtttggggctgggagaggagctccagccttgggattcccagctgtctccactcggtgatcggcactgaatacaagagactcaacagtggtaggtttgggctgagtcgttgggttttccttgttgtcttaagttttaaagggtcgtcgtagtgtcgaggtcgngagcgtgggtgggacgggtccgggggagtcgttcggtccggacggggtcccgggggggtccctaggaaacctcgtacgagttggcgcgacggtcttcgtggtacttacgacttagttcgaggtacggtacgtacggtacttaagttacgtacggttccgggacccgtaccgtacgttccggaccggggaaccgggggtaaacgggtcgggttagggacgggttcgggtaccggtttccgggtaaccggtaaacgtttaaaccggaaaaccccgtaaaccgtacggtaaaacgtaaacggtaacggtaaccgtaaaacggttttaagtttaacggtcgtcggtagggtccggttacgggacggaacgtaacgggacgttacggtaccctaaccgtacttacccgacgtaagtaacgtacgttacggtacttaacggaacgaacgtaacccggtacggtacgttaacgttacgaacgaaacttaaacgtaacggtaaaccgacgggtaaacctaaaccgggaaacggtaacggaacccggtacggtacggtttaacggttaaccttacggtaggaccgacgtaacgtaactacgtttaccggtaacgttacttttaacgttagttttcgaaggttccggtaacgg

SEQ ID NO: 59702 - DNA, 815 bp, Homo sapiens
  misc_feature: GYAE6OF01AMA1X.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgtctattttaaaaggtgtccagtgtcaggtgcagcgtgggtgggaggtccggggggaggtcgttgggtcccgacggggtccccggggggggtccctaggaaacctctcagttgtgcgaggctcgtggtactcactattcagtcgacgtccggtctacgtacgtacgtcggggtcccgaccgagtcgtacggaccgggggtaaacgggtcggtagggtacggttcgggtcgtttacgggtacccggttaagttaacccgaaaacccgtaaaaccgtacggaaacgtaaacggtacccggaacggtaaaccttaagttttacgtcggtacgtcgggtcggttacgggtcggacggtaacgggtcccggtacggtttaccccaaccgtaactccgtaccgtaaggaagtacgtacgtaacgttaccggaaggtaaacggaaccgtacggtaccgttaacgtcgttacgaaacgtaaacgtaacggaaacccgtacggtaacccgtaaacggtaaaacccggacgggtaacccgtaccggggtaccgttacggttacgttacgttacggtacgtaccgtaacgtaccgttacgttacccggttaacgttaccgtttacgtttaacgttttccggtacggttccggttacccgg

SEQ ID NO: 59703 - DNA, 876 bp, Homo sapiens
  misc_feature: GYAE6OF01A8XRO.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggaggtttgggctggagtcgttgggtttttccttggttgacttaatttttaaaagggtgtccgagtgtcaggtgcagctgggtgggagggtccggggggaggtcgttgggtcccgacggggtccccgggggggttccctacggaaaaccttcctactagtggtcggcgacggtcctcgtggtacttaccaactattaccgagtaggtaccgtcggtacttaacgttagttaccggtcggggttaccccgccgtaacggttccggtacgggtacccggggggtaaaagggtccggtggggtaggttcgggtaccggttttacgggtacccggtttaagttaaaaccggaaacccctaaaaccgttacggaaaccgtaaacggtaacccggtaccggtaaactttaaagtttacgtcggtacgtcgggtcgggtcggttacggacgtaacgggtccgtaaccgggtttacccaaacccgttacttaccccgtaaccgtaacggtaaggtacgttaacgtaacttacggaacggtaacggaaaccggtaccgggtacgtaacgtactacgtaaactaacggtaacgaaccgtaaccggtaaaccggtaaaccgggaaaaccggacgggaacccggttaccgggtaccgttacgttacgtaacgttcgtacgtacaacgtaccgtacgttacccgttacgttaacgtttacgtttacgttttccgtaggttcccggttaacccgg

SEQ ID NO: 59704 - DNA, 1019 bp, Homo sapiens
  misc_feature: GYAE6OF01ETO4J.26.57.F02.1.454.CMB.1.raw
tcagagactatactcacgaccggtgctcgatttagctcgatatagttgggtttggggctgggagaggagctccagccttgggattcccagctgtctccactcggtgatcggcactagaatacgaagagactcaccagtggtaggtttgggctgagtcgttgggttttccttgttcgtacttaagttttaaaaggtcgtaccgtagtgtcgtaaggtgcgaggtcgtgggtaggggacggggtccggggggtagtccggttacgggtccggaccggggtcccgggggggttaccctaacggtaaccttccgtacgtagtcggtcgcgtacggtcgttacgtacggtacttacctacgtaacgttcgtacggttacgaccgttacggtacttaacgtacggttaccggttcggggtcccgtaccggtaacgggtccggtaccgggggaaaccggggtaaacggggtcggttacggggttacgggttcgggtaccggtttaccgggtaaccggtttaaaaccgtaaaaccggtaaacccctaaacggttaacggaaacccggtaacggttaacccggtaaccgtaaaacgtttaacgtttacggtacggtcggtttacgggtaccggggttaccgggacggttaacgggaacgggttaccgtacgtaccccgtaaacttaccgtacctacgggtaaacgtaacggttgtaacggttaacgtaacgggtaaaccggtaaaccggtaccgggtaacggttaccgttaaccgttaccggtaaacgaaaccgtttaaagggtaacccgaaaccggttaacccgggttaaccggtaaaaaacccgggggaaaccccggttaaccggggtaccccggttaaaccgggttccggtttaaaacgtttcggttaaccgtaccggggtacctaaacccgggtaccgttaaaccgttcccgttaaacccgggttttattaaaaccccggttttggttttaaccctttaccggggtaccgttcccggtaacggg

SEQ ID NO: 59705 - DNA, 858 bp, Homo sapiens
  misc_feature: GYAE6OF01E5EOA.26.57.F02.1.454.CMB.1.raw
tcagagactatactcacgaccggtgctcgatttagctcgatatagttgggtttggggctgggagaggagctccagccttgggattcccagctgtcctccactcggtgatcggcactgaatacaagagactcaccagtggaggtttgggctgtagtcgttgggttttccttgttcgtactttaagttttaaaacggtcgtccgtagtgtcgagggtcgcgtagcggtggggtagggaccggggttccggggggaggtccggttcgggtacccggaccggggtccccggggggttaccctaacgtaaccttcgtacgagttggtcgacgtacggtccgttacgtacgtacttactacgttacgtacgtacgtaccgtacgtaccgtaacttaacggtaccggtaccggtccgggtacccgccggtacggtacggtaccggggaacgggacgggtcggtagggtacggttccggtaccggtacccggtaaacgttaaaccggtaaaccgtaaaaccgtaaccgtaacgtaaaccgtaaacggtaccgtaacgtaacgtttacgttaacgtcgtcggtaccggtcggttacggacgtaaccggtaccgtacgttaccgaccctaacggtcgtaaccgaacgtaaggtaactaggtactaaggaacgtaacgaaccgtacgtacggtactagaacgtacgaaacgtacgaaccgaaccggtacgaaaccgggtaaccgtaacggaccgtaacggtaccggtttagtaccgttacgacgtaccggtaccctacgaaaccgttaccgttcccgttaagtttaacggttcctttacgggttaacgtttccgacggtccgttacggg

SEQ ID NO: 59706 - DNA, 897 bp, Homo sapiens
  misc_feature: GYAE6OF01D5E7F.26.57.F02.1.454.CMB.1.raw
  modified_base (619)..(619): a, c, t, g, unknown or other
  misc_feature (619)..(619): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctggagtcgttacgggtttttccttggtttagtactttaaagtttttaaaaacggtcgttaccctaaggttggttaccgtagggttcgacgaacggtccgttggggttacggggacggggttacccgggggggtacggtaccgttttcgggtacccgggaccgggggtacccccgggggggggtttacccctaacggtaaaaccgttccgtaccgtaaggttggttcggacggtacggggtccttcggtacggtattaccgtaacgtacgtttacgaacggttcggaaccgttccggttaccttaattacgttaccggtccgggtaccctacccgtaggttccggtaaccggggaccggggtaaaacggtccggttggtaacgggttcggtaccgttacggtacgttaaacgtaaccgtaaaacccgtaaaccgtacgaaacgtaaccggtacgaccgttaactaaggtttacncggtacgtagggtccggtgggaccgtacggaacgtcgtacgtaccctactaccgtactacggagtagtacgttaagacgttaacgaaggtaaccgtaaacggaccggttaagtactaggttaacgtaacgaaacgtaacgaagaccgtaaaccgaaaccgggtaaaccgaaccggtacggtaccggtacgttaagttaccgtaggtaccgtacggtacaacgtacgtacgttaccggttagtttaaccgttattttagtttcgttccgtaggtacccg

SEQ ID NO: 59707 - DNA, 907 bp, Homo sapiens
  misc_feature: GYAE6OF01EQTC2.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagtcgttgggttttccttgttgtactttaagttttaaaggtgttaccagttgtacgaggttcggctaggtcgtggggtagggacgggtccgggggggagtccggttcggtaccggtacggggcccgggggggttcctacgaacctccgtacgagtggtcgcgtacgtcgtcgtaggtatcctacgtacgttcgacggttacgacgttcggtaccttaagttacggttaccggtccggggttcccgtaccggaccgggttaccgggttacggggaaccggggggtaacgggtcgggtacggggtggttcgggtaccggttacgggtaaccggtttaacgtaaaccggtaaacccctaaaccggttacggaaccgtaaaccggtacgggtaacctaacgttaaactttggtaccggtcgttccggtaccgggttacggtaccggaacgtaacgggtaccgttcgttaaccgtacctcttaaccgttaaccggaacgtagttaacggttaacgttacgtaacgtaaacggaacggttaaaccggcgtttaaccgttcggttaagccgtaaacgtaaggtaaacccgtaccgaaccgttaaaccggtaacgggtaaaacgggaccgggtaacccggtacggttaacccgttaagttaccgggaatttcccggaacggttaggaacccgtccggtttaaacttcccggttaaccctttaggtttacccgttttaaaggttttcccgtaaccggtcggtaaccccg

SEQ ID NO: 59708 - DNA, 748 bp, Homo sapiens
  misc_feature: GYAE6OF01BJ58A.26.57.F02.1.454.CMB.1.raw
tcagagactatactcacgaccggtgctcgatttagctcgatatagttgggtttggggctgggagaggagctccagccttgggattcccagctgtctccactcggtgatcgacactgaatacaagagactcaccatggagtttgggctgagcttgggttttccttgttgcttaattttaaaaggtgtccagtgtcaggtgcagctgggtggaggtccggggggaggcgttgggtccgagggcccgggggggtccctaggaaacctctcagtgtgcgaggctcgtggattcactattcgagtcgacgtcggtactaattataccgtcggggtacccgccgtagtcgtcgggacccggggtaaagggtccgtagggaggttcggtcgtttacgggacccgttaattaaccggaaaaccctaaaccgtggaaacaacggtaaccgacgtaactaagtttagtcgtctacggcggttcggtcgaacgaacgggtccgtacggttaccaacctacgttacccgtacgtaaggaacgtatacggtaacttacggaaggtaacggaaaccggtacggtaccgtaagttcctagaacctaaacgtaacgaaccgacggtaacccgtaaaggaaacccggacggaccgaccgggtaccgttagttaccgttacgtacgtcgaccgaacgtaccgtaccgttacccgttacgtttaacgtttacgtttacgtttttccgtaacgggttcggtaaccccg

SEQ ID NO: 59709 - DNA, 886 bp, Homo sapiens
  misc_feature: GYAE6OF01BQZGY.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggagtttgggctggagtcgttgggttttccttggttgactttaagttttaaaaagggtgtccgaggttgtcgaggtcgcgagtcgtgggtgggagggtccggggggaggtcgtttggggtcccgacggggtcccggggggggttccctaggtaaaccgtctacagtgtgcgtaggtcgtcgtaggtattcctacgtagttacgacgtcgtaacgtcggtacttagtacgtaccgtcggggtccgaccggtaggtacggtacggggaacccggggtaaggggtccgtagggtacgttcgggtacggttacggtaccggttaaacgttaaccggaaaacccgtaaaccgtacggaaacgtaaaccggtaaccggtaacccggttaattaaccgtttaagtaccgtacggtttacggcccggttagggtaaccgaccgggtaacgggtaccgtaacggtttacccgaaccttacgttaccgtaaccggtaaggtaaacgtaggtacgtaaaccgttagaaacgggtaaaccggacggttaaaccgggtacggttaacttaccgtaacggtaaacgtaaagttaccggttaaacggaccggttaaaccggtaaaaccgggaaacgtacggggaacccggtaacggggtccgttaaagtttaccgtagttaccgggacgtacggtaaccggtactaccggttacggttacgttacggtttaacgttttcgtttacggtcggtttcggtaacccgg

SEQ ID NO: 59710 - DNA, 861 bp, Homo sapiens
  misc_feature: GYAE6OF01DYN01.26.57.F02.1.454.CMB.1.raw
tcagagactatactcacgaccggtgctcgatttagctcgatatagttgggttggggctgggagaggagctccagccttgggattcccagctgtctccacgtcggtgatcggcactgaatacaagagactcaccagtgggtaggtttcgggctgagtcgttcgggttttccgttgttgtactttaagttttaaaagggtcgtaccgtaggttcgtacggaggttcgcgtaggtcgttcggggtaggggtacggggtccggggggaggtcggttcgggtacccggacgggggtccccggggggttaccctacggtaaaccttcccgtatcgttggaccgcgtcggtcgttacggtatactacgtacttacgtacgtacgtacgtacgtacgtactagtaaccgtccggtacggtcccacggtacggttacggacggggtacgggtaacggtcggtgggtacggttcgggtacccggtagtacgttaaccgtaaaccgaaccgtaaccgtacgtaaccgtaaccgggttacgacgttaaacgtttaacggttactcggtaccggtacgggtcccggtacggaaccgtacgggtaccggtaccggttaaccgtacctacgtaaccgtaccgaaggtacgtacgtaacgtacgtactacggaacgtaacgggaacctacggtaccgtataccgagtaacgaaacgtacgaaaccggtaaccgtaacggtaaaccggaacggtacgggaacccggttacggtaaccgttagttacccgtacggtacggtaaccgaattcggaaccgttaccgttacgttaactttacgttttaacgtttaccggttaacgttccggtaggtaaccgg

SEQ ID NO: 59711 - DNA, 798 bp, Homo sapiens
  misc_feature: GYAE6OF01BORT2.26.57.F02.1.454.CMB.1.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
  modified_base (720)..(720): a, c, t, g, unknown or other
  misc_feature (720)..(720): n is a, c, g, or t
tcagagactatactcacgaccggtgctcgatttagctcgatatagttgggtttggggctgggagaggagctccagccttgggattcccagctgtctccactcggtgatcggcactgaatacaagagacctcaccatggagtttggctggagtcgttggtttttccttgttcgtacttaagttttaaaaggtgtcagtgtcaggtncagcgtgggtcggagggtcggggngtcgttggtccgacggggtccgggggtcctagaactctcgagtcgtcgacgtggtctcgtgtacttacactacgttgagttcggaccgttacggtacttaagtaaccgttcggaccgggtccctaccgtacggttcggtacgggaaaccggggaacgggtcggtacgggtaggttccgggtcgttaccgggtaaccttaaacgtaaccggaaaccgtaaccggtagtaaaccgaacgtacgtaaccgaactttaagttacgtcgcgtccgggtcggttaccggagaaccggtacggtaccgttaccgtactaaccctcgtaaccgtaccgaaggtacgttacgtaacgtagtaaccgaagggaaccgtaacccgggtacgttagttacgtacgtaacgaaacgtaacgtaacgaccgtaaccgtaccggaaaacggaaaccggtccggaacgtaccgggttacttaacgtagtaccggttgaacccggtanaacggtacccgttaacgtcccgtttaaacgttttcgtttaacggttttaccgttacggtacccggtttaggtacccgg

SEQ ID NO: 59712 - DNA, 807 bp, Homo sapiens
  misc_feature: GYAE6OF01AU1AL.26.57.F02.1.454.CMB.1.raw
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagcttcgggttttccttgttgcttaagttttaaaaggtgtccagtgtcaggtgcagcgtgggtgggagggtccggggggaggtcgttcgggtcccgaacggggtccccggggggggtccctaggtaaacctcctcgatggtcggcgaggtcctcgtaggtacttccacttattccgagtcgtactccggtattaactacgtaccgttggggtccccgaccgtacggtcgtaccggggaacggggaaacgggtcggtggggtagtcgggtcgtttagggacccgttaagttaaccgaaaacccgtaaaccgtagaaaccgtaaacggaccgtaccgaaactttaaacgtttagcggtacttacgggtaccgggttcggtacggacggtaacggtcgtacgggtaccccaaacgtcttaccgtaaccgtaaggaagttaccgggttaggtaaacttccgggtaacgggaaaacgtaaccgggtaccgtaacggttactaccggtagtaaacgtaaacgtaccgaacgtaccgggtaacctaaaccgggaaaccggacgggtaacccgcgggtacttaaggtactaccgtgaccggactacgtacgtaccgtccgtttaacgttaacgttacctttttaggttcctgggtacccgtaccgg

SEQ ID NO: 59713 - DNA, 968 bp, Homo sapiens
  misc_feature: GYAE6OF01E2PY4.26.57.F02.1.454.CMB.1.raw
  modified_base (677)..(677): a, c, t, g, unknown or other
  misc_feature (677)..(677): n is a, c, g, or t
tcagagactatactcacgaccggtgctcgatttagctcgatatagttgggtttggggctgggagaggagctccagccttgggattcccagctgtctccactcggtgatcggcactgaatacaagagacctcaccagtggaggtttgggctgagtcgttgggtttttccttgttgtacttaagtttttaaaaggtcgtaccgtaaggttgtacgaggttgacgagtcgtggggtgggacgggtccgggggaggtcgtttacgggcccggtacggggtcccgggggggttacccctaggtaaacccttccgtaccgtagttggtcgtacggacggtcgttacgtaggtaacttcaacgttacgttacgtacggttacggacccttcggtacttaacgttaaggttaccggttccggggtccccgtacgttacgggtaccggtaccggggaacccgggggtaaacgggtcggtacggggtacggttacgggttccggttacggttacccggtttaaacgttaaaccggaaacccgtaaaccgtaacgaacggtaaaccgtaccgtaacggtaaactttaagtttacgttacggtccggttacggtaccgggttaccggtacggtaacggtaaccgggtacgggtttaacccgaaccgtaaccccttgttaaccccggtanaaacgggtacttaggtaacgttaacgttaaccggggaaattacccggtaaaacggtcccgggttacgttaaaccgttacggaacgttaaaaccggaaacttaacgggaacccgtaaaccggttaccgggaaaaacccggtacgggaaacccggtacggggtaccgttacgggtttaaccgttacgttaaacggttccggaaccacgtaacgtaacccgtttacggttacccgtttaggtttaaaccgtttttaacggtttacttttcgggaaccggttcccgttaaacggg

SEQ ID NO: 59714 - DNA, 693 bp, Homo sapiens
  misc_feature: GYAE6OF01DZG88.26.57.F02.1.454.CMB.1.raw
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (451)..(451): a, c, t, g, unknown or other
  misc_feature (451)..(451): n is a, c, g, or t
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggagtttgggctgagcgttgggttttccttgttgtacttaattttaaaaggtcgtccagttgtacgaggtgcgagcgtgggtggagggtccgggggagtcgttggtccggagggtcccgggggtcctagaaacgtcacgagtggtgcgaggtctgtggattcgactattcagtgaccgtgactaagtacgtacgtcgggtccacgacgtcgtacgggaaccggggtaaggtctagggngttcggtcggttaggacgttaanaaccgaaactaaccgagaacgaacgtacggactaaacttaagttacgcgtacgngtacggtggtacacgtaaggaccgtagtacactactcgtacagtagactgtaatcgaagaacgaacgcgtatacngtaaccganaaaggtaccaacgtaacgaaccggtaacgaaacgggtacggtaacgaccggtcgtaaacgttaccgttaatcgggaccgtaacctacggacgttacctttcccgttaaaggttcccttttaaaggtttattttaccgaaccgggttccctaaacgggg

SEQ ID NO: 59715 - DNA, 744 bp, Homo sapiens
  misc_feature: GYAE6OF01BI445.26.57.F02.1.454.CMB.1.raw
  modified_base (199)..(199): a, c, t, g, unknown or other
  misc_feature (199)..(199): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgtcttattttaaaaggtgtccagtgtcaggtncagctgggtggaggtccgggggaggcttggtccgaggtccggggggtccctgaactctcatgtgcaggtctctggattacactacttctaggtcgtactcggactatactaccgtcgggcccgccgtagtcgtacggaccggggaaggcgtgggagtcggtcgttcggtccgttaagttaaccgaaacccaaaccgtagaacgtaaacgtacgacgtaactaacgtttagtcggtactggtcggtcggtagacggaacggtcgtacggttccaaccctacgttccctacccgaggaacgtaacgtagtacttacgaagaaacgtaaccggaacgggtacgttacgttaccgtagtaactaaagtaaccaaacgacggtaaccccgaaaccggtaaaaacccggagggaaccccgaaccgggtaccggttacgttaaacgttaaccgtcggtccgaacccgaacggtaaccgttacccggttaccggtttaaccgtttaccgttttaaccgttttacgttttacggtacgggtttccggtaacccg

SEQ ID NO: 59716 - DNA, 916 bp, Homo sapiens
  misc_feature: GYAE6OF01CBHDT.26.57.F02.1.454.CMB.1.raw
  modified_base (750)..(750): a, c, t, g, unknown or other
  misc_feature (750)..(750): n is a, c, g, or t
tcagagactatactcacgaccggtgctcgatttagctcgatatagttgggtttggggctgggagaggagctccagccttgggattcccagctgtctccactcggtgatcggcactgaatacaagagactacaccatggtagtttgggctgagtccgttgggttttccttggttgactttaaagttttaaaaggtcgtaccgtagttgtacgtaagggtcgacgtaggtccgttggggtacggggtacggggtacccgggggggtacggtccggtttccggggtacccgggaaccggggggtacccccggggggggggtttacccctaaccgggttaaaaacccgttccgttaccgtaaggtttcgggtcggaccgtacggggttccgttccgttacggggttaacttttacccgaaaccgttacgtttaccgaaccggttaccggtaaccgttacccggttacttaacgttaacggtttaccccggttcggggtcccccgtaaccggtcggtttacccgggaaccggggtaacccgggggtaaaggggtccggttaggggtacgggtttacgggttccgtttaaccggggtaacctttaaaccgttaaacccggttaaaacccgtaaaccgtaaggtaaacccgtaaacggttaccgtaaccgtaatttaaacggtttgtcggtacgtcggtccggtaggtacgacggaacggtcgtaaccgttaccaacgtcttccgagtagattagtntactacgaagacgaacgtccgtaactagtcgaagtacaaacggtacacggaaccgtacggaaacgaaacccggtacgtaccggtacgtacgttagttacctacgtcggtacctacggactcgtacccgttccgttagttaatttaccgtttacttgtccgtcgtcg

SEQ ID NO: 59717 - DNA, 778 bp, Homo sapiens
  misc_feature: GYAE6OF01AY8UP.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttggttttccttgttgtacttaagttttaaaggtgtccagtgtcaggtgcgagcgtgggtgggacggtaccgggggagtcgttcggtccggaacggggtcccgggggggtacccttaggaaacttccgtacgagttcggtcgacgacggtcttcgtcggtactttactaactacgtttaccgagttacgtaccggtcggtacttaacgttacttaccggtccggggtcccgccgtaacggttcccggtagggtaccggggaacgggtcgtagggtacggtcgggtcgttacgggtacgttaacgtaacgaaacccgtaacgagaacgtaacggactacgaatttaattcgcgtcgtcggtacggttcggagtaccggtagtacgtacgtaccacctctacgtaccgagtacgtagtcgtaacgttacgaaagtaacgaacgtacgtaggtacctttacgagtaaccaaggtaaccaaacgtacggtaaccgtaaaaccgggaaccggtacggaacccggacgggttacttaacgtaacgttacggtacgacgtaccgagtaccgttaccgtacggtttaacgtttacttaacggttttactttacgggttacgtccgttaaccggg

SEQ ID NO: 59718 - DNA, 874 bp, Homo sapiens
  misc_feature: GYAE6OF01ETAZ4.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggtttccttgttgcttattttaaaaggtgtccaagtgtcaggtgcagcgttgggtgggagggtccgggggaggtcggttggtcccgacggggtccccgggggggtcccgttaggaaaccgttaccgtctacgttggtacgtcggacggtcgttccgtaggtaacttccgaaccgtagttaccgtaacggttggtaaccgttccgggtaacttaaacgttaccgttaaccggttaccggggtaccccgtaccggtaacgtttccggtcggaaaaaccggggggtaaccgggttcggtacgggttacgggtcgtttgggtccggttaaccgtttagtaaaccggaaaaaacccctaacggtaacgaaacggtaaaccgtaccggtaccgaaacgttttaaacgtttagcgtaggtccgtacgggttacggtcgaaacggtaacggctaaggggtttcccaaacccggtagttacccgttaccgtaacggtaaacgggtactacgtaacttacgaaacggtaacgtaaacgtccgggtaacgtaacgttacgtacgaaccgtaaaagtaccgtaaacgtaccggtaaccgtaaacgaaaacccggaacggtaaccgtaccgggtaccgtacggttaaccgttacgtcggtaccgtacgtaacgtaccgttacgtaccgttacgtaacgtttacgttacctttttacgtacggttcggtacccg

SEQ ID NO: 59719 - DNA, 852 bp, Homo sapiens
  misc_feature: GYAE6OF01AL7BM.26.57.F02.1.454.CMB.1.raw
  modified_base (188)..(188): a, c, t, g, unknown or other
  misc_feature (188)..(188): n is a, c, g, or t
tcagagactatactcacgaccggtgctcgatttagctcgatatagttgggtttggggctgggagaggagctccagccttgggattcccagctgtcctccactcggtgatcggcactgaatacaagagactcaccatggagttggctgagtcgttgggttttccttgttgtacttaagttttaaaaggngtaccgagtgtacgaggtgcgaggcgtgggtgggagggtccgggggagtcgttcggtcccggacggggtcccggggggtaccctagtaaaccgttccgtactagtacggtcgacggtacggtcccgttaccggtattaccactacgttaccgacggtcgtaccgtccgtacgttactacgtaccggtcggtcccgacgtacggtccgtacgggaaccgggtacggcgtgggtacgtcggtcgtacggtaccgttaactaaaccgtaacccgaaccgttaggaactacggtaacgaccgtaattaagtttacgagtcgtacgggtacgtcggacgtacggtaccgtacggttacgtaaccctaccgtacgtaccgcggtaacggaacgttagtacgtacgtacgacgtaaacggaaccccggttacggtaccgtacgtaacgtacgaaaccgtaaagtacggtaaacccgacgtaaacccggtaaaaccggtaaaccggaacgggtaacccggacgggtttaacgtaacccggttacttacggtaaccctaaccggtcccgtaaagtacccccggttaaggttaccccggtttaaccgtttaaacggtttaacccggttttacgttttaaccgggcgggttttaaccccgggaccgttacggggg

SEQ ID NO: 59720 - DNA, 789 bp, Homo sapiens
  misc_feature: GYAE6OF01DS67S.26.57.F02.1.454.CMB.1.raw
  modified_base (199)..(199): a, c, t, g, unknown or other
  misc_feature (199)..(199): n is a, c, g, or t
  modified_base (263)..(263): a, c, t, g, unknown or other
  misc_feature (263)..(263): n is a, c, g, or t
  modified_base (297)..(297): a, c, t, g, unknown or other
  misc_feature (297)..(297): n is a, c, g, or t
tcagagactatactcacgaccggtgctcgatttagctcgatatagttgggttggggctgggagaggagctccagccttgggattcccagctgtctccactcggtgatcggcactgaatacaagagactcaccatggagtttgggctgagctgggtttcttgttgctatttaaaggtgtccagtgtcaggtgcagctggngggagtccgggggaggcttggccaggcccgggggggtccctggaaacctctcatgtgcaggctntggattccgacacttcgagtacgtactaccggtntaacgtagtacgttcgggtcccgaccgtgtccggtgggacccggggtaagggcgtgggaggttggtacgttcgggtaccgtagttaacgaaaccaaccgtagaacgtaacgtaacggacgacttaaagttactcgtacgttggcggtcggtaggacgaacgggtgtaaccggttacacccggacttcccgtacgagtaacgtaatacggtaactcgaaagggtaacggaacggtaaccggtaccgtttaagtcctaagggtaaccctaaagttaaccggaaaccgtacggtacccgttaaaacccgggggaaaaccggtaaccgggaccggtacccggggttaacctacgggttttaaaccgtttaccgacggtttaaaccggccggaaacccgtaaaccgttcccgtttaaccccgggttgtttaaaacccccggtttttaacgggttttaatttttccgggttaaacccggggttgtttaaacccccggg

SEQ ID NO: 59721 - DNA, 760 bp, Homo sapiens
  misc_feature: GYAE6OF01BOIWS.26.57.F02.1.454.CMB.1.raw
  modified_base (240)..(240): a, c, t, g, unknown or other
  misc_feature (240)..(240): n is a, c, g, or t
  modified_base (359)..(359): a, c, t, g, unknown or other
  misc_feature (359)..(359): n is a, c, g, or t
  modified_base (623)..(623): a, c, t, g, unknown or other
  misc_feature (623)..(623): n is a, c, g, or t
  modified_base (633)..(633): a, c, t, g, unknown or other
  misc_feature (633)..(633): n is a, c, g, or t
tcagagactatactcacgaccggtgctcgatttagctcgatatagttgggtttggggctgggagaggagctccagccttgggattcccagctgtctccactcggtgagtcggcactgaatacaagagacctcaccagtggtagtttggctgagtcgttggttttccttgttgtactttaagttttaaaggtcgtacctagtgtacgaggtgcgtagcgtgggtggtacgggtaccggggnggtcgttcggtccggacgggtcccgggggtacctagtaaacctctcgtagtgtcgcgagtcgtcgtgtacttcactattcgagtaccgacgtcgtattatacgttccggtcggtacccncgtacggtcggtaccgggaacgggaacggtcgtacgggtcggttggtccgttacggtaaccgtttaaagtaaccgaaaaccctaacggtaaggaaccgtaacggtaaccgtacgttaaatttaaacgttggtaccgtacgggttaccgtcgggttacggtacggacgtaacgggttaccgtaccggttaaccaaccgttcgtaaccgtacgaagtactagttaacgagtaacgacggtaagaaccgttgtaccgtagttacganaaacgtaaanacgtaaaccggaccttaaacggaacgaaaccgcgaaccgggtacgttacgtagttacgtaccgtacgacgtcctaacgtactcgttaacttcgtttaaacttcgtttacgttagtccggtcggtacg

SEQ ID NO: 59722 - DNA, 837 bp, Homo sapiens
  misc_feature: GYAE6OF01BVSK6.26.57.F02.1.454.CMB.1.raw
  modified_base (204)..(204): a, c, t, g, unknown or other
  misc_feature (204)..(204): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccagtggagtttgggctgagcgttgggttttccttgttgacgttaagttttaaaaggtgtccgagtgtcaggtncagtcgtggtcgggaggtccgggggagtcgttcggccgacggggtccggggggtacccctaggtaaacctcgtactagtcggtcgcgaggtcctcggtaggtactacaacgtgtacgagttcggagtacggtacttagtacgtaccggttcgggtccccgacgtacgttaccggccggtaaccggggtaaagggtcgtagggtagtcgggttcgtacgggtaccttaagttaacccgaaacccgtaaacgaaggtaaaccaagggtaaccgtaaccgtaactttaaagttaacggtcgttaccggtacggttccgggtacggacgtaaacgaagggtcccgtacggtaacctacgtaccgttacccgagaaggttacgaagttacgtaagttaacgacgtaaagaccgtaacccggtagtaccgtacgaacgtaactaagtaaccggacgtaacccgtacggtaaaaacccggtacggaacgggttaaccggtaccccgggtttagtaaccggttacgttacgtacggttaacccgacgtaaccggtaaacccgttcccggttaaccggttaacgtttaacccggttttaagttttacccgggttacgttaccggttacccgggttaaccccg

SEQ ID NO: 59723 - DNA, 879 bp, Homo sapiens
  misc_feature: GYAE6OF01D8WEY.26.57.F02.1.454.CMB.1.raw
tcagagactatactcacgaccggtgctcgatttagctcgatatagttgggtttggggctgggagaggagctccagccttgggattcccagctgtctccactcggtgatcgacactgaatacaagagactcaccatgggagtttgggctgagtcttgggtttttccttgttgcttaattttaaaaggtgtccagtgtcaggtgcagctggtggaggtccgggggaggtcgttcgggtccgacgggcccgggggggtccctaggaaaaccttcctactagtgtgcgaggtcttcgtggtacttccgaactattcagtcgaccgtcggcttaatagtaccgttcgggtccgccgtacgtccgtcgggaccggggaaagggtcgtagggaggttcggtcgtttacgggacccgttaagtttaacggaaaccctaaaaccgtcggaaaccgtaaacggtacccggacgtaaactaaagttttaacgtcggtacgttacggtccgggttacgggtacggtaccggaacgggtaccgtaacgggtttacccaaaccctaacgttccctaccggaacgtaacggtacttacggtaacgtttacgaaacggaacggaaaccgtaccgggttaccgttaacgttacgtacggaactaaacgtaacggaaaccgtaaccggtaacccgttaaaacgggaaaacccgggtaacgggaacccggtaaccgggtacccggtttaaacgtttaaccggtttaaccggttcggttaacccggaacccgttaaccgggtaacgtaacccggtttaccccgggttaccggtttttaaaacgtttacccggtttttaaccggttttttcggtaaaccgggtttccggttaaccccggg

SEQ ID NO: 59724 - DNA, 845 bp, Homo sapiens
  misc_feature: GYAE6OF01EVPKJ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctattttaaaaggtgtccagtgtcaggtgcagtctggtgggtaggtcgggggagtcgttggtaccagggccggggggtcctggaaactcgtcagtgtgcgacggtctcgtggatttcagtacttcagtgacgtcggacttagtactacgtcgggtacctcgacgttcgtaggccgggaaacggtcgtgggtagttcggcgtttcggacgttaagtttaaccggaaaccctaaaccggttacgaaccgtaaggttacccggacgtaactttaacgtttaaccgtgcggttaccggtacgggtttcccgggtagaacggttaagggtaaccgttcgggtttaccaacccgttaagttacccgtaccgtacggtaacgtacggttacggtaacgtttacgaacgggtaaagtaaccggaaaccggttccgttaacggttaccgtaacgggttaacgtaaacggttaacgtaaacccgaaacgtacccggttaaaacgggaaaaccccggttaacggtaaccccgggttaacgggggaaccccgtttacggttaaacccgtttacggttaccgggtaaccgtaaccggtaaccgttaacgtaccgggtttaaacccccgtttagtttaacccgttttaacggtttacgttttttaccgaacggttttaccggttaaccggg

SEQ ID NO: 59725 - DNA, 932 bp, Homo sapiens
  misc_feature: GYAE6OF01DRYHC.26.57.F02.1.454.CMB.1.raw
tcagagactatactcacgaccggtgctcgatttagctcgatatagttgggttggggctgggagaggagctccagccttgggattcccagctgtctccactcggtgatcggcactgaatacaagagactcaccatggagtttggctgagtcgttgggttttccttgttgtacttaagttttaaaaggtgtaccaggttgtcgtaggtgcgtaggtcgtgggtgggacgggtccgggggagtcgttcggacccggtacggggtccccgggggggtaccctaacggaaccttccgtacgtacgttcggtcgaccggacggtccttaggtacggtaactttaccgaaacgttacttaccggtaacggttaccggtaccgttaccggggtacttaaacgttaaccggttacccgggttacccggggtacccccgtaccgggtacggtttcccgggaaccgggggtaacccgggggtaaaggggtccggtagggtaacgggttcgggttaccgttaccggggttaaccgttaacggttaaaccgtaaaaaccccgtaaccgtaggaaacgtaaacggttaccggtacgtaaatttaacgttacgtccgtacggtcgtcggtacggacgtacggtaacggtaccgtaacggttaccctaacggtacctaaccggtaaccgtaacggtaagtaacggttacggtaacgttaccgggaaacggtaaaccggtaaaccggtacggttaaccttacgtacgtaacgaaactaacgaaccgtaaaccggtaacgtaacccggtaaaccgggaaacccggtaacgggacccggtaacggttaccgttaaggtacccgttaagtccggttaacgaccgtaacggtaccgtaccgttaccggttaacttaacgtttacgttacttttacggtacggttccgtaccgg

SEQ ID NO: 59726 - DNA, 878 bp, Homo sapiens
  misc_feature: GYAE6OF01A6TGM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggttttccttgttgcttaattttaaaaggtgtccagtgtcaggtgcagctgggtggaggtccggggggaggcgttggtccgacgggcccggggggtccctaggaaactctcagtgtgcgaggctacgtggacttcactattacgagtgaactcggacttaattacgtacgtcggggttcccgccgtaggttccggtacgggacccgggggtaaaacgggccgttaggggtaacggttcggggttaccgtttacggggaccccgtttaaagtttaaaaccggaaacccccgtaaaaccgtacggaaccgtaaaacggtacccggtaaccgtaaacgttaaacgttttagcggtaccgtgggtccggttacgggtagtaccgaaagggtccgtaacgggttccctaaacccgtaccgtaccgttacccgtaaaggaacgtaacggtacgtaagtttaccgaacggtaacgtaaaccggaccggtacgttaacgtaccgttagaacctaaaacgtacgtaaaccgtaaccgggtaaccgttaaaccggggaaaaaccccggtagggaaaccccggtaccgggtaccggttaaacgttaacgtttaacccggttacggtacggtaacccggtaacggtaaccccggttaacgttcccgggttttaaacgttaacgttttaacggttttaaaccgttttttcggaaccgggtttcccggttaacccgg

SEQ ID NO: 59727 - DNA, 805 bp, Homo sapiens
  misc_feature: GYAE6OF01BUPFP.26.57.F02.1.454.CMB.1.raw
  modified_base (212)..(212): a, c, t, g, unknown or other
  misc_feature (212)..(212): n is a, c, g, or t
  modified_base (505)..(505): a, c, t, g, unknown or other
  misc_feature (505)..(505): n is a, c, g, or t
  modified_base (555)..(555): a, c, t, g, unknown or other
  misc_feature (555)..(555): n is a, c, g, or t
  modified_base (568)..(568): a, c, t, g, unknown or other
  misc_feature (568)..(568): n is a, c, g, or t
tcagagactatactcacgaccggtgctcgatttagctcgatataggttgggtttgggctgggagaggagctccagccttgggattcccagcctgtctccactcggtgatcggcactgaataacaagagactcacctagtggtagtttgggctgagtcgttgggttttccttgttgtacttaagttttaaaaggtgtcctagttgtcgaggtncgagtcgtgggtggtacgggttccgggggagtcgttcgggtccggacggggtcccgggggggttacctacggtaaacttccgtacgtacgttggcggtacgtacggtcgttcgtaggttacttacctaatacttcgaagtcgtaccgtcgtactatacgtacgtccgggtccacgtacggtcgtcgggaaccggggtaagggtcgtagggacggtcgggttcgtcggtaccgttaagttaaccggaaaccctaacgtagaaccgtaaggtaacccgacttaaacgtaatttcnggtactcggtcggtaggtcgaacggtaacgtcgtaacgtcccacgttacnctaggagtacgtntagtactacgaacgtaacgacgacccggtttacgtataaccgtagaaaggtaacaacggaaccgtaaccgtaacggaaaacccggtagtaaccgggtaccccgttagttaagttaaaccgtcggtttacggcccgtaacgttaaaaccgggcctttaaaccgggttcccggtttaaacgttttaacgtttaccgttttttaaacccgtttgggaacccgggttcggtaaaccccggg

SEQ ID NO: 59728 - DNA, 881 bp, Homo sapiens
  misc_feature: GYAE6OF01EICSP.26.57.F02.1.454.CMB.1.raw
tcagagactatactcacgaccggtgctcgatttagctcgatatagttgggtttggggctgggagaggagctccagccttgggattcccagcctgtctccactcggtgatcggcactgaatacaagagactcaccagtggtaggtttggctggaggtcgttgggtttttccttgttcggtacttaaagttttaaaaggtgtaccgtaggttcgtacgagggttcgacaggtccggtggggtaggggtacggggttacccggggggaggttcggtttccgggtaccgggaacgggggtccccgggggggttaccctaggtaaaccttcgtacgtgtcggtacgcgtacggtcgtacgttggtacttacgacttagttccgtaggtcgtacgttcggtacttaacgtacgtaccggttcgggtccgtaccgtacgtcggtacgggaccggggtaacggtcggagggtacggtcggttcgttcggtacttaacgtaaccgaaccacgtagaacgtacgacggtaactaacgtatttacgtcgtcgtccggacgttacgggacgtaccggaaggttaccgtaacgggttcccaaaccgtacgtttacccgaaccggtaagtaccgtaacggtaccgttagtaaccgaaacgggtaaccgaacccgggtttaaggtcccgtaagtttaccgaacggtaagtaaacccgtacggaacccgttaaacggtacccggaaaaaccgggtaacgtacccggggaaacccgtccgggttaacggtttaacttacgggtaacgttacccgtaggtaaccgaaccggttacccgtttaccggttacgttaccggttttataccccgtttttaaaggtctaccggttaccgtacgg

SEQ ID NO: 59729 - DNA, 729 bp, Homo sapiens
  misc_feature: GYAE6OF01B2I4A.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggtttttccttgttgcttatttttaaaaggtgtccagtcgtcaggtgcagctgggtggaggtccgggggagcgttggtccgacgggcccgggggggtccctagaaaccttctacagtgtcgcgaggtcctcgtggtattaccgactactttccgaggttcgtaccgttcggactatacgtacgtcgggtcccgtccgagttccgtacggacccggggtaaggtcgtaggaggtcggtccgttcgggtaccgttaagttaacgaaaacccgtaaccgtcgaaccgtaaacggtacccgacgtaacttaaactttacgtcgtacgtcggtcggtcggacgacgaacggtcctacggtacccaccgtacttccgtaccaggtaacgtacgtgtaactacgaaggaacgtaacccgtacggtaccttacgtcgtacgtaataacgtaacgaccgaacgtaccgtaaacgaaaccggcgtaccgaccggtacgttacgttacttacgtagtccgaccgtagtacctacgttcccgttaacgtttacgtttactttacgttttcgtcggttccgtaccgg

SEQ ID NO: 59730 - DNA, 916 bp, Homo sapiens
  misc_feature: GYAE6OF01BRPQ8.26.57.F02.1.454.CMB.1.raw
  modified_base (209)..(209): a, c, t, g, unknown or other
  misc_feature (209)..(209): n is a, c, g, or t
  modified_base (562)..(562): a, c, t, g, unknown or other
  misc_feature (562)..(562): n is a, c, g, or t
tcagagactatactcacgaccggtgctcgatttagctcgatatagttgggtttggggctgggagaggagctcagccgttgggattcccagctgtctccactcggtgatcggcactgaatacaagagactcaccagtggtagtttgggctgagtcttgggtttttccttgttgtcttaagttttaaaaggtgtccagtcgtacgaggttncagtcgttggggtgggacgggttccggggggacgtcgtttgggcccgacgggggtccccggggggtttaccctacggtaaaccgttccgtacgtagttgggttacggcgtacggtcgttaccgttaggtactttaccaacttacgtttacgtaggttcgaaccgttccggaccttaagttacgttaccgtacggggtcccctacgtacgttccggtacggggacggggaagggtcgtagggtagttcggtcgtttccgggtaccttaaacgtaaccgtaaaacccaacgttacggaaacctaacggtaccgacggtaactaacgttttagcggtacgttcggaccggttcggngtaacgtaacggtcgttaacggttacctaccgtaccgttacgtaaccgtaaggacgttgtaaccgttaacgttagaaaggtaaaccggaacccggttaagtacccgttagttaccgtaccggaaattaaaccggtaaccgaacggtaaacccgttaaacccgtaaaccggggtaaaaacccggtacggaaccccgggtaacggtttaccccggttaaattttaacccggttacgttacggaaccttacccgggaaaccgtaacccggtttacgttacccgggttaaacgtttttacggttttaaaccggtttttacgtttttacccggaaaccgggtttccggttaaacccggg

SEQ ID NO: 59731 - DNA, 733 bp, Homo sapiens
  misc_feature: GYAE6OF01EDLPV.26.57.F02.1.454.CMB.1.raw
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
tcagagactatactcacgaccggtgctcgatttagctcgatatagttgggtttggggcgtgggagaggagctccagccttgggattcccagcctgtctccactcggtgagtcggcactgaatacaagagactacaccatgggagtttgggctgagtcgttgggttttcctgttgacttaagttttaaaaggtgtccagtgtcgaggtgcaggcgtgggtagggaggtccggggggagtcgttcggtccgacggggtcccgggggggtaccctaggaaactctacgagtggtcgcgaggtcctgtaggtacttcaatcgttcagttcgacgtccggtatatatacggtcggtccgcngtcgnggaccggaaggcgtggagtggtcgttggaaccgttagtaaccgaaaacctaacgtgaaactaacgtacgacgtaataatttacgcgtacgngacgttcggganacggaacgcgtagtaccacctacgtacacgagtaagacgttgaacgttacgaaggtaacgaaaccggtacgggtaactacggttaactaggtaaacgtaaacgttaaccgaaaccgtaccggtaaacccgtaaacggggaaaacccaacgggtaaccggtaaccggtacccggttagttaaaccgtagtaccggtactacggaactacggtaaccttacggttaacgtttaactttaacggtttagttttaccgtacgtccggttaacg

SEQ ID NO: 59732 - DNA, 872 bp, Homo sapiens
  misc_feature: GYAE6OF01CUYKB.26.57.F02.1.454.CMB.1.raw
  modified_base (860)..(860): a, c, t, g, unknown or other
  misc_feature (860)..(860): n is a, c, g, or t
tcagagactatactcacgaccggtgctcgatttagctcgatatagttgggtttggggctgggagaggagctccagccttgggattcccagctgtctccactcggtgatcggcactgaatacaagagaactcaccatggagtttgggctgagctgggttttccttgttgactaatttaaaggtgtccagtgtcaggtgcagctggtggaggtccgggggagcgttggtccaacgggcccggggggtccctagaaaccgtctacatgtgccgaggtctacgttggtacttactaacctatttcgaaggttcgaacgttaccggtaccgttaaactattaaccggttcggggtaccccgaccgtacggtacgttacggggtaccccggggaaaaagggtcccgtagggtaggttcgggtaaccgtttagggtacccccggtttaaaagtttaaccggaaaaaccccttaaaaccggttcggtaaaaccggtaaaacggtaacccgtaaccggtaaaccctaaaagtttttacggtaacggtccgtacgggtaaccgggttacccgggttacgacccggtaaaacgggtaccgtaaacgggtttaacccgtaaacccgtaaccttaccggttaaccccgaaagggtaaacggtaaacgtttaacgtaaccggtttaacgaacggtaaacggaaacccgtaaccgggttaaccgttacgttaccgtacgtaacgtaaaactaacgaaaccgtaacggaaccgtaacgaaaaccggaacgaccgtaccggtaccgtaacgttaagtacgtacgtacgacacgtacgtaccgtaccgttaacggtactttaacgttagtttttacgngttcgtaaccgg

SEQ ID NO: 59733 - DNA, 982 bp, Homo sapiens
  misc_feature: GYAE6OF01EEUE7.26.57.F02.1.454.CMB.1.raw
  modified_base (129)..(129): a, c, t, g, unknown or other
  misc_feature (129)..(129): n is a, c, g, or t
tcagagactatactcacgaccggtgctcgatttagctcgatatagttgggttggggctgggagaggagctccagccttgggacttcccagcctgtctccactcggtgagtcggcactagaatacaaganactcgaccagtggtaggtttgggctggacgtcgtttcgggtttttccgttagttacgtacgttttaaagttttaaaagggtgtaccgtaggtcggtacgaggttcgacacggtcgttcgggtacgggtacgggtaccgggggtaggtcggtttaccgggtccggaacggggtcccggggggtaccctaacggtaaacctccgtacgtagttcggcggtacggtacgtctcgtagtcctagtacgtattgacgtacgtctacggcttaacgtacgttaccggtcggaccgtacgtacgttacggggacggtaacggggaacggtgtcgggtacgggttcgacggtttaccggtaccgtaaacggttaaaccgaaaacccgtaaccggtaacgtaaacggttaaacccggtaacgtaccggaaattttaaaacgtttcgtaacccggtttaagtcccgggggtaaaccggtttaccggaaccggtaaccggggtaacggttaacccgggtttaaggtaaccccgtaaaccggttaccgtaccccggtaaaggttacgggtaaacgttagttaaccggttaactaaccgggtaaaggtaaaccaaccggggttaacctaccggttaaacgttacgtaaacccgtaaagaaccgtttaacggaaacccgtaaccggggttaaaccgaaaaccggtaccggtaaacccggaccgtaaccggttaaccggtaccggttaaacttaacgggtacggtaaccgaacccggttaaggaacccgtttaaccgtacccgggttttaaattaacccggtttttaacgtttaacccgttacgttacccgggttaacgttaacccgg

SEQ ID NO: 59734 - DNA, 797 bp, Homo sapiens
  misc_feature: GYAE6OF01EL0NE.26.57.F02.1.454.CMB.1.raw
  modified_base (129)..(129): a, c, t, g, unknown or other
  misc_feature (129)..(129): n is a, c, g, or t
  modified_base (180)..(180): a, c, t, g, unknown or other
  misc_feature (180)..(180): n is a, c, g, or t
  modified_base (215)..(215): a, c, t, g, unknown or other
  misc_feature (215)..(215): n is a, c, g, or t
  modified_base (355)..(355): a, c, t, g, unknown or other
  misc_feature (355)..(355): n is a, c, g, or t
  modified_base (469)..(469): a, c, t, g, unknown or other
  misc_feature (469)..(469): n is a, c, g, or t
tcagagactatactcacgaccggtgctcgatttagctcgatatagttgggttggggctgggagaggagctccagccttgggagttcccagctgtactccactcggtgactcggcactagaatacaaganacctcaccgatggtaggtttggcgtgtagtcgttggttttcctgttacgtntttaagtttaaaaggtgtcctagtcgtcgaggtcncgagcgtggtgggaggtccgggggagtcgttcgtccggacgggcccggggggtactacgtaactcgtactagtcgtagcgacggtctcgtaggtacttcactagtcgagtgtactcgacttactcgtacgtccgggtacnccgtagtccggtcgggaaccggtaggtcgtaggtcggtcggtacgttccggtacgttaacgtaaccggaacccacgtacgaacgtaacgacctaaccgttaacgtaagtttacncgtacggttccggacgttacggggaccaacgtcggttaactacgtacctaaccctgtacccgtaacggagtaaacgtctaacgtacgttaacgaaggtacctaacggtaaggtccctttaaggtaccacgtaaaacggttctaaacgggaaccgttaccggaaccgtaaaaccggaacgtaccggtaaccggaaccccggttgttaacctcggggttaaccctgggtacctaacccgggtcttaaaccggggtaccctttaaccggttaacgttttacggttttaactttaaaccggtttccgggtcccgttaacgggttaaccccgg

SEQ ID NO: 59735 - DNA, 762 bp, Homo sapiens
  misc_feature: GYAE6OF01BYMU6.26.57.F02.1.454.CMB.1.raw
  modified_base (523)..(523): a, c, t, g, unknown or other
  misc_feature (523)..(523): n is a, c, g, or t
  modified_base (590)..(590): a, c, t, g, unknown or other
  misc_feature (590)..(590): n is a, c, g, or t
tcagagactatactcacgaccggtgctcgatttagctcgatatagttgggtttggggctgggagaggagctccagccttgggattcccagctgtctccactcggtgagtcggcactagaatacaagacgactcaccagtggtggtttgggctgagtcgttgggttttccttgttagtactttaaagttttaaaggtgtaccagttcgtcgagggtgccgagtccgttaggggtcggggtacgggttacccggggggaaggttccgtttaccggggtacccggtaaccgggggtcccccggggggggtcctaacggttaaaccctccgtaactaggttggcgtccggaggtcctggttagtctacctatactacgtggtctacgtcgattagtacgtcggtcggtccagacggtcgtcgggaccgggtaaggcgtgggaggtcgtcggttacgtcgtaagttaacgaacctaaacgcgtaacgaaagtcgtaagtaacttaacttagcacgttgggcgacggtnacggtacgtacgttacgtccctaagtccgtacgaccgtagaacgtaggtactaagtacgaacggaanaacggtacgtacgtacgtactaacgaagtaacgtaacgacgaacgtaacaacggtaaccgtacggaaccgtcgtaacgttactaccggtagtacgtacgaaccgagtaccgttaccgtaaggttaccgtaaggtttcgtttaacccgttaggtcccgttaaccggtacccgg

SEQ ID NO: 59736 - DNA, 774 bp, Homo sapiens
  misc_feature: GYAE6OF01B8KGI.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtcgggggagtcttggtccaggccggggggtccctagaaacgtctcatgtgcaggctctggattcactattcagtgacgtccggtactatacgtacgtcggggtccccgccgtaggtcgtcggacccgggggaaaagggtctaggggtacgttgggtccgtttacgggaccgttaagttaacggaaacccaaaaccctggaaaccgaaacggttaaccggacgtaacttaaattttaagtcgaccgttgaccggtttcgggtacggacgtaaagggtccgtaacgggtttcccaaaccctacgttacccgtaacccgtaaggtaacggtaagtaacggttaacgttaccgtaaaggaaacggtaaacggaaccgggtacgttaagtacccgttaagtaacgtaaaacgtaacgtaaacccgtaacgtaccccgtaaaccggaaaacccggaacggaacccggtaaccggtacccggttagtaacgttaccgtagtaccgaccgacgtaactacgtacccgttacgttaagtttaccgtttagtttttacgaggttccgtacccgg

SEQ ID NO: 59737 - DNA, 820 bp, Homo sapiens
  misc_feature: GYAE6OF01AE9JD.26.57.F02.1.454.CMB.1.raw
tcagagactatactcacgaccggtgctcgatttagctcgatataggttgggtttggggctgggagaggagctccagccttgggattcccagctgtctccactcggtgatcggcactgaatacaagagactcaccatggagtttggctgagcttggtttcctgtgcttattttaaaaggtgtccagtgtcaggtgcagcgtgggtgggaggtccgggggaggtcttgggtccgacgggcccggggggggttcccctaggaacctctactagtaggtacgcggagtcgttcgttacggtaacttacacgtacttcgtaagttcgaccgttcggactatacgtacgtcggggtcccgtacccgtagtcgtacgggaccgggggtaaaggggccgttaggggtacggttgggacgtttacgggaccgttaacggttaacgaaaacccgtaaacccgtagaaaccgtaaacggtacccggtaacgaacgtttaaacgttttaacgtcggtaccgttcggtacccgggtacggtcgaacggaacgggttaccggtaacggtttcccaaccggttaacctcccgtacgaaacggtaagtacttaacggtacttaccggaaaggaaaccggtaaaccggtaccggtacgttaaccggttctacggtaaacgtaaactaccgaaacgaccggtaaccgtaaacggaaaccgggaaccgtacggacccggtaccggttagttaaaccgttgtaccgaccgacgacggtactaccgggttccgttacttaaccgttttacggttacttttacggtcgttccgggtaacccg

SEQ ID NO: 59738 - DNA, 898 bp, Homo sapiens
  misc_feature: GYAE6OF01BI461.26.57.F02.1.454.CMB.1.raw
tcagagactatactcacgaccggtgctcgatttagctcgatatagttggggtttggggctgggagaggagctccagccttgggattcccagcctgtcgtccactcggtgatcggcactgaatacaagagactcaccagtggagttcgggctgagcgttgggttttccttggttcgtacttaagttttaaaacggtcgtccgtagtgtccgaggtgcaggacgtgggtacgggagggtccgggggaggtccgttcggtaccgtacggggtcccgggggggtaccctacggtaaaccgtcgtaccaagttcggtacgtacgtacgggtcttaccgtagggtaacttccgaacgtacttacggaaggttcgaacggttacggtaacctacgttacgttaacggtcgggtaccccgaccgtacgtccggtacgggtaaccgggggtaacgggccgtggggtaccggtcgggtaccgttagggtacccgttaaagttaaaccgaaaccctaaccggtaacgtaaacccgttaaacggaccggtaacccgtaaaccgttaattttaacggccgtacggtaccgggttaccggtccggggtaggaccgggtaacgggacgttaaccgggacctaacccgtacgttaccgtacgacggtaagtcgtaagtagttaccgaaggtaacgtacccggaggtaccttagaccgtacggtaacgtaaacgttaccgggtaaacccggtaaccgtaaacggaaaccggttaaaccggggaccggtaccgggtacccgggtacgttacggttaccgttagtccggtacgtaacccggaaccggtcttaccccggttacgttaaccgttaacggtttacgttttagtttaccgaccgggtttccgtaacccggg

SEQ ID NO: 59739 - DNA, 790 bp, Homo sapiens
  misc_feature: GYAE6OF01DMI3J.26.57.F02.1.454.CMB.1.raw
  modified_base (206)..(206): a, c, t, g, unknown or other
  misc_feature (206)..(206): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagtcttgggtttttccttgttgacttaagttttaaaaggtgtccagtgtcaggtcgnagctggtggtacggtccgggggagtcttcggccgagggcccggggggtaccctagaacctctcatggtgcgagtcctcgtaggtattcacattccgagtcgactcggactatacgtcgtcgggtcctccgtagtccgtggaccggggaaggcgtagggagtggtctttcggaccgtaagtaccgaaacctaaacgtcgaacaacgtacgaccgaacttaattacgcgtacgtcggtacggtacggtacgacggaacggtcgtaacggttaccaccgtacttaccgtaaccgagtaacgacgtaagtacttaacgacggtaaacgaaccggacgggtacttacggttacgagtaacaaacggtacgaaaccgtacgtaacccgtaaacggaaaacccggtacggtaacccgtaacgggttaacccgtttaaagtacccggtttaaaccgtacgggtaacccgttaacccggtaaacgttaccccgttaaccggtttaaaccccggttaacgttttaaaccgtttttaaacgggtttttacccttttttaaacgggtcccggttttaacccggggttaaaccccgg

SEQ ID NO: 59740 - DNA, 838 bp, Homo sapiens
  misc_feature: GYAE6OF01CC8HV.26.57.F02.1.454.CMB.1.raw
  modified_base (659)..(659): a, c, t, g, unknown or other
  misc_feature (659)..(659): n is a, c, g, or t
tcagagactatactcacgaccggtgctcgatttagctcgatatagttgggtttggggctggggagaggagctccagccttgggattcccagctgtctccactcggtgatcggcactgaatacaagagactcaccagtggagtttgggctgagtcgttgggttttccttgttgtactttaagttttaaaaggtgtaccgtaggttgtacgagggtgtcgaggcgttgggtgggacgggtaccggggggacgttcgttcgggtccggaccggggtcccgggggggtaccctaacggtaaacctcctacgtagttcggtcgtacgacggtccttggttacggtactttacgaaccttacgttacgacggttcggtaccgttaccggtactttaacgttaacggttacccggttcgggggtaccccaccggtaaccggttccggtaccggggtaaacccgggggtaacggggtcggtacggggtacggtcgggttcggttaaccgggtaaccggttaacgttaaaaccggaaaaccccgtaaaccggtacgtaaacgtaaccgggtaccgtacgtaacgtttaattacgtcgtcggtacgtcggtacggtacgacggtacggtccgtaaccgtacgtacctacgtaccgtaacgagtacgtanacgtacgtacgaaggtaaccgaacgtacggtactactacggtaacaacgtaacgaacgaacgacgtaacgaacgaaacgcggacgtacgtcgtaggttacttcgagtccgagtaacgtcgttacccgttcgttaactttaccgttacgttttaccggtttacgtggttcccggtaacgg

SEQ ID NO: 59741 - DNA, 726 bp, Homo sapiens
  misc_feature: GYAE6OF01CEXQ3.26.57.F02.1.454.CMB.1.raw
  modified_base (713)..(713): a, c, t, g, unknown or other
  misc_feature (713)..(713): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctggagtcgttgggttttccttggttgtacttaagttttaaaaaggtgtccaggtgtcaggtgcagcgtggtggaggtccgggggagtcgttgggtccgacgggtccggggggtaccctaggaaactcgtacgagtgtgacaggctcgtggtattcgactattcgagtgacgtcggactatactacgtcgggtccgtctacgtctcggaccggtaaaggtcgtggagtcggtcgttcgggtaccgttaagtaacgaaaccctaaaccgtcggaaacctaaaggtaccgacgtaaactaagttttacgcggtacgtcggtcggtacgggtcgaaccggaacgggtccgtaacgggttacccaccgtacgtaccgtaccgaaggtacgtagttaacgtagttaacgaacggtaacgaaccggtacggtacgtaactcgttaacgaactaaacgtacgaacgtacgtaaccgtaacgggaaaccgtagggacctaccggtacgtcgttacgtacgtcgtacgaccgtaacgcgtaccgtccgttaacgttacgttaactttagttttccgnggttccgttaccg

SEQ ID NO: 59742 - DNA, 680 bp, Homo sapiens
  misc_feature: GYAE6OF01AYHEI.26.57.F02.1.454.CMB.1.raw
  modified_base (575)..(575): a, c, t, g, unknown or other
  misc_feature (575)..(575): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatcggagtttgggctgagctgggttttccttgttgctattttaaaaggtgtccagtgtcaggtgcagctggtggagtccgggggagcgttggtccaggccgggggggtccctggaaactctcatggtgcgaggctgtggtatcactattccagtgaccgtcggctagtataccgtgggtcccgccgagttcgtcggaccggggtaaagggctagggacgtgggctttcgggaccgttaagttacggaaccaaccgtggaaccgtaacgtaccgcgaactaactttacgacgtcgtagccggttacggacgtacgaagggtcctaggttcccaccgtactaccgttaccgacgaagtacgtgtacttacgaacggaacggaaccgtaccgggtcgtaactcgtacgtaacaaagtacaaacgacgtaaccgtaaggaaaccgnggaaccgacgggcccgttagtaacttacgtgtaccgaccacgtaaccctcgtaacccggttctttaacgttacccgttatttttcccgagggttccgtaccccgg

SEQ ID NO: 59743 - DNA, 764 bp, Homo sapiens
  misc_feature: GYAE6OF01DGACR.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacaagagactcaccatggagtttgggctgagtcttgggttttccttgttgtcttaattttaaaggtgtccagtgtcaggtgcagcgtggtggacggtccgggggagtcgttggtccgacgggtcccggggggtccctagaaacctctacagtgtcgacgaggtctcgtaggattaccactattaccgagtcgaccgttccggtacttaagtaacgttaccggttacggggtaccccgaccgtaacggttcccggttacggggaacccgggggtaaaacggggtcgttaggggaacgggttcgggttaccggtttacgggtaccccgttaaagtaaaccgaaaaccgtaaaccgttagaacgtaaacggtaccgacgtaactaaatttcgtagtcgtacggtcgtcggtagaccgaaggttcgacggttccaccgtactccgtacagagtaactagtactacgaagtacgaacgacggtactatcgtacgtaactaaacgtagaaaccgtacgaccgtaaacggaaaccgaacggtccgacggtaacccgttagttaaccgttaggtaccgtacgtaccgaacgacgttaacccgttcgttacgtttaactttaccgtttagttttaccgagttcccgggttaaccg

SEQ ID NO: 59744 - DNA, 922 bp, Homo sapiens
  misc_feature: GYAE6OF01BI399.26.57.F02.1.454.CMB.1.raw
  modified_base (212)..(212): a, c, t, g, unknown or other
  misc_feature (212)..(212): n is a, c, g, or t
  modified_base (530)..(530): a, c, t, g, unknown or other
  misc_feature (530)..(530): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtaggtttggcgttgagtcttgggtttttccttgttgtacttaagttttaaaggtgtccgagtgtacaggtgacgngacgtgggtgggtacgggtccgggggagtcgttaggtccgacggggtcccgggggggtacctacggtaaacctctacgtgtgtcgtacggacgtcgtacgtagggtacttccaacgttacgttaccgttaaggtcggtaaccgttcggttaaccttaagttaccgttacggttccggggtccccgtaccggtaacgttccggttaacgggaacgggggtaacgggtcgtacggggtaggttacgggtcgttacggtaccgtaacgtacggtaaaaccctaggacgtaacgtacgggtacgtacgtaactaagtttacnggtaccggtgtacgggtcggtacggaccggtaaacggtccgtaccgttaccgtaacgttcgtacctacgtaacggtaagtagttaacgttacgttaaccgaaaggaaaccggttaccggtaacgggttaccgttaacgtaccggttaacgtaaacggtaagtaaaccgggttaacggaaaccggtaaacccgggttaaaaaccgggaaaccggggtaaccggggttaacccgtacccggggtttaacccggttaacggtttaacggttacgttaaccggtccgtaaacccggtaaacggttaccttaacccgggttacccgttaaacggttttaccggttttaaacctttaacggtttttccggtaaccgggtttaccccgttaacccgggg

SEQ ID NO: 59745 - DNA, 738 bp, Homo sapiens
  misc_feature: GYAE6OF01CMDG8.26.57.F02.1.454.CMB.1.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (565)..(565): a, c, t, g, unknown or other
  misc_feature (565)..(565): n is a, c, g, or t
  modified_base (579)..(579): a, c, t, g, unknown or other
  misc_feature (579)..(579): n is a, c, g, or t
  modified_base (589)..(589): a, c, t, g, unknown or other
  misc_feature (589)..(589): n is a, c, g, or t
  modified_base (710)..(710): a, c, t, g, unknown or other
  misc_feature (710)..(710): n is a, c, g, or t
tcagagactatactcacgaccggtgctcgatttagctcgatatagttgggtttggggctgggagaggagctccagccttgggattcccagctgtctccactcgtgatcgcactgaatacaagagactcaccatggacgtttgggctgagtcgtgggttttcccttgttgcttaattttaaaaggngtaccagtgtacaggtncagcgtggtggnggccggggagtcgttcggtccgaacggggccggggggttacccaggtaaacctctacgacttcggacggtccaggtcttcgtaggtacttacacgtattcaggtcgaccgtcgacttaagtagtaccgtgggtacccaccgtagttaccgtcgggaacggaacggtcgtaggacgtgtacgttacggacgtaattaacggaaacctaaccgagaaactaaacggtccgaacgtaacttaagttacgtgtacgtagtcggtaccggttagacggtaaaacggtctaaccggttacaccgtacgtacacgtaacgagtacgtagacttagaagaaccgtaacgacggcgtaancgtacgaacgtaanaaaccggtanaaaccggtcgttaaaaccgaaacgggtaccacggtaaccggtacgttaacgttacgttaacggtacgtcgtaaacccgaacgttaccgtaccgtacgtttaaccgttaacgttaacgtttntttaaaccgtggttaccggtaaacccgg

SEQ ID NO: 59746 - DNA, 818 bp, Homo sapiens
  misc_feature: GYAE6OF01BOOHN.26.57.F02.1.454.CMB.1.raw
  modified_base (513)..(513): a, c, t, g, unknown or other
  misc_feature (513)..(513): n is a, c, g, or t
  modified_base (707)..(707): a, c, t, g, unknown or other
  misc_feature (707)..(707): n is a, c, g, or t
  modified_base (719)..(719): a, c, t, g, unknown or other
  misc_feature (719)..(719): n is a, c, g, or t
tcagagactatactcacgaccggtgctcgatttagctcgatatagttgggtttggggctgggagaggagctccagccttgggattcccagctgtctccacgtcggtgagtccggcactagaatacgaagagtacctacaccgtagtggtaggttttcgggactggtaggttccgttttcggggttttttccttaggtttagttaacgttttaaagtttttaaaacgggtcgtacccgtaggttcggtacggtaagggtcgaccgtaggtcgggttaggggtcggggtacggggtacccggggggtgttccgggtttccggggacccggggtaccgggggggtcccccggggggttaccttaaacggtaacgttccgtaccggtagttcgggtcgcggtaacggttccgtacgttaggtactacctagtactcgtagtaccggtacgtattacgtaagtacgtccgggtccggtaccgcgtaggttccgacgggtaacgggagcgggttacggnggtttcggacgtttacgggaacttaacggtaaaccgaaacccgtagaaccgtaacgaacggtacgaccgttaattaagttacggcttacgggtccgggtacgtacggaacgaccggttacggcgttacgaccttaccgcgtaccgagtacgtagtactaacgtagtacggaacgtacgacggtactctacgtanacgagaacgtanaccgacgtacgaacggagccgacggtactagtacgtataccgcgtacgatacgtctacggttctttagttactttacgtattcgggtactcggtaccgg

SEQ ID NO: 59747 - DNA, 749 bp, Homo sapiens
  misc_feature: GYAE6OF01B67KJ.26.57.F02.1.454.CMB.1.raw
  modified_base (500)..(500): a, c, t, g, unknown or other
  misc_feature (500)..(500): n is a, c, g, or t
  modified_base (539)..(539): a, c, t, g, unknown or other
  misc_feature (539)..(539): n is a, c, g, or t
tcagagactatactcacgaccggtgctcgatttagctcgatatagttgggtttggggctgggagaggagctccagccttgggattcccagctgtcctccactcggtgatcggcactagaatacaagagacctcaccatggtagtttcgggctggagtcgttcgggttttccttgttgtacttaagtttttaaaaggtgtcctaggtgtcgaggtcgcgagtcgtgggtgggagggtccgggggaggtcgttcgggtcccggacggggtcccggggggtacctagtaaaccgtcgtacgagtcggtacgcgacggtctcgtggtactcgactagttcagtacgtactcggtactaagtacgtacggtcgggtccaccgtaggttccggacgggaacccggggtaagggtccggtagggtacggttacgggcgttacggtaccgttaagtaaaaccgaaacctaaacggacgaaacgtaacggtacgaactaatactttagngtcgtgtcccgtaggcgacgtaagcgttacgacctaacntaccacgaaggtactaagttacgactacgaacgaacgtaccgacggtactacgtacgaacgactaaagcgaaacgtaccgaacccgaaacgggaaccgaacggaccgaacgggtcttaacgtaccttacggtcgaactacccaacggtaaccgtccttacgggttactttaacgggttactttttaacggttctaagggttccgtaaccg

SEQ ID NO: 59748 - DNA, 765 bp, Homo sapiens
  misc_feature: GYAE6OF01EPIBF.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcttgggtttttccttgttgtcttaattttaaaaggtgtccagtgtcaggtgcagcgtgggtggacggtccgggggaggtcgttcggtccgacgggtcccgggggggtccctaggaaacctctcgagtgtgcgaggtcctcgtggtacttccactattcagtcgacgtcggtactatacgtacgttcgggtcccgccgtagtcgtcgggaccggggaaagggccgtgggtaggtcggtcgttacgggtacccgttaagttaaccgaaaccctaaaccgtacgaacgtaaacggtaccgtaccgtaaccgttaattttaacgcggtaccgttgggtcccggttcgggacggaccggtaaacgggtcccgtaacggtttaccccaaccctaacgttacccgtaccggaaggtaacgtagttaacgtacgttacgaaggaacgaaaccgtacgggtaccgtactaccgtagaactaaacgtacgaacgacgtaccgaaaccggaaacggacggaaccgtacggtacgtacgttacgttaccgttcggaccgacgaacggtacctacgttaccgttacgtttacttacgtttaactttttcgacggttccgtaacccgg

SEQ ID NO: 59749 - DNA, 757 bp, Homo sapiens
  misc_feature: GYAE6OF01B8O1J.26.57.F02.1.454.CMB.1.raw
  modified_base (132)..(132): a, c, t, g, unknown or other
  misc_feature (132)..(132): n is a, c, g, or t
tcagagactatactcacgaccggtgctcgatttagctcgatatagttggggtttgggggctgggagaggagctccagccttgggattcccagctgtctccactcggtgatcggcactgaatacaagagactnaccatggagtttgggctgagctgggttttctgttgctattttaaaaggtgtccagtgtcaggtgcagctggtggaggtccgggggaggcgttggtccaggccgggggggtcctggaaactctcatgtgcaggctctggattcactattcagtgactcggactatatacgtcggggtccgccagtcgtcggccgggaaagggctgggagtgggctttgggaccgttaagttaacggaaaaccctaaaccgtaggaaaccgaaaaggtacccggtacggaaactaaagttttaagtggccttagccgggttacgggtcggtacgaaacggggctaacgggttaccacctactaccgttaccctaaaggaaggtaattaggtaagtttacgaaacgtaaacggaaaccgtaacgggacgttaacgttacgtaggtaacctaaaagttaacggaaacgaacgtaacccttaaacgggaaaacccggtaacgggaaccgtaacccggggccggttaacggttaacttaacggtggttaccgtaccgaacgtaccggtaaccgttaccggttacccggtttaacgtttaaccggtttaatttttttacggtacggttccgggttaacccgg

SEQ ID NO: 59750 - DNA, 607 bp, Homo sapiens
  misc_feature: GYAE6OF02GJQ58.26.57.F02.1.454.CMB.1.raw
  modified_base (154)..(154): a, c, t, g, unknown or other
  misc_feature (154)..(154): n is a, c, g, or t
  modified_base (178)..(179): a, c, t, g, unknown or other
  misc_feature (178)..(179): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (187)..(188): a, c, t, g, unknown or other
  misc_feature (187)..(188): n is a, c, g, or t
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggngttcgtctaggcgactaagtagcnntngncagnngngatcgggagctgcagcggggtccngaactctcatgtgcagctctggattcacattcagtgacgtcgctatatacgtcggtccgccgcgtcgtcggacgggaacgggacgtaggtaggtggtcgtcggtaccggtacgttaacgtaaaccgtaaaccgtacgaacgtaacgtacgacgaactaacttagtacgtcgtcgtcgtcggtacgacgaacggacgtacgtacgtacctactacctaccgacgagtagtagtacgtacgacgaacgaacgacggtacgtacgtacgtacgacgtaacgtacgaacgacgaccgtaacgaaacgaacggaacgacgtacgtacgtacgtacgtacgtcgacgacgacgtacgtaccgtacgttacgttacgttactttacgttacgtcgtaccg

SEQ ID NO: 59751 - DNA, 600 bp, Homo sapiens
  misc_feature: GYAE6OF02HTPPK.26.57.F02.1.454.CMB.1.raw
  modified_base (153)..(153): a, c, t, g, unknown or other
  misc_feature (153)..(153): n is a, c, g, or t
  modified_base (167)..(167): a, c, t, g, unknown or other
  misc_feature (167)..(167): n is a, c, g, or t
  modified_base (176)..(179): a, c, t, g, unknown or other
  misc_feature (176)..(179): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttgggctgagcggngttcgtcgtaggcnttaagtgcnnnngncngnngngncgggngntgcatcggggtccngaactctcatgtgcaggctntgattcacattcgagtgacgtcgctatatacgtcggtccgccgacgtcgtcggacgggaacggacgtggaggtggtcgttcggtcgtagttaacgaaaccgaaacctacgaacgaacgtaacgacgactaaattatagtcgtcgtcgtcggtcgacgaacggacgtacgtacgaccactctaccgagagatagtatacgaagaacgaacgacggtacgtagtctacgactaagtacgaacgacgaccgtaacgaaaccgaacggaacgaaccggaccgtacgttacgttacgttacggtcgtaccgacgaacctaacgtaccgttacgttacgttaacgtttacgtttttacgttacgttacggtaccg

SEQ ID NO: 59752 - DNA, 526 bp, Homo sapiens
  misc_feature: GYAE6OF02GKT0V.26.57.F02.1.454.CMB.1.raw
  modified_base (373)..(373): a, c, t, g, unknown or other
  misc_feature (373)..(373): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaggctggagtggcttggccgtattagaaccaacctgacaagtacgcgacaatttangctgcgtcgggtgcaaggcaggttcaccatctccagagatgattcagagaacacggcgtatctgcaaatgaacagacctagaaaccgaggacacggaccgtgtattactgtcgccagacatccgtcgtactacgtatttttctagtgtacccg

SEQ ID NO: 59753 - DNA, 564 bp, Homo sapiens
  misc_feature: GYAE6OF02F0V17.26.57.F02.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (168)..(168): a, c, t, g, unknown or other
  misc_feature (168)..(168): n is a, c, g, or t
  modified_base (178)..(181): a, c, t, g, unknown or other
  misc_feature (178)..(181): n is a, c, g, or t
  modified_base (183)..(183): a, c, t, g, unknown or other
  misc_feature (183)..(183): n is a, c, g, or t
  modified_base (186)..(187): a, c, t, g, unknown or other
  misc_feature (186)..(187): n is a, c, g, or t
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggngttcgtntaggcgnttaagtgtcnnnngngcnnctgngancgggngctgcagcggggccngaactctcatgtgcaggctctggattcacattcagtgactcggctatatctggtccgcagtctgccggaaggctggagtggcttggctattagaccaaactgacagtacgngacaatttangctgcgtcgtgacgaaggcgacgtacacactctcagagagtagtatacagaacgaacgacgacgtactactacgacaacgtagaacgacgaccgtaacgaaaccgaaacggaacggaaccggtaccgttacgttacgttacgttacggtcgtaccgtaacgtaaccgtaccgttaccgttaccgttacgtttaaccgtttacgtttttacgttacggttacggtacccg

SEQ ID NO: 59754 - DNA, 529 bp, Homo sapiens
  misc_feature: GYAE6OF02G9WQ0.26.57.F02.1.454.CMB.1.raw
  modified_base (373)..(373): a, c, t, g, unknown or other
  misc_feature (373)..(373): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaaggctggagtggcttggccgtattagaaccaacctgacaagtacgcgacaatttangctgcgtcggtgcaaggcaggtcaccatctccagagatgattcagagaacacggcgtatctgcaaatgaacagcctagaaaccgaggacacggaccgtgtattactgtgccagacactccgtacgtacttacgttatttttcgtagttggtacccg

SEQ ID NO: 59755 - DNA, 534 bp, Homo sapiens
  misc_feature: GYAE6OF02ICBFF.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaaggcaggttcaccatctccagagatgattcagagaacacggcgtatctgacaaatagaacagacctagaaaccgaggacacggccgtgtacgttactgtcgccagacactccgtcgtattacgtatttttctacgttggtacccg

SEQ ID NO: 59756 - DNA, 547 bp, Homo sapiens
  misc_feature: GYAE6OF02GT4J3.26.57.F02.1.454.CMB.1.raw
  modified_base (362)..(362): a, c, t, g, unknown or other
  misc_feature (362)..(362): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtaggctatttaaagtgtcagtgtcaggtgcagctggtggagtccgggggaggcttggtccagccggggggtcctgaaactctcatgtgcaggctctggattcacattcagtgactcggctatatactggtccgccagtctgccggaaaggctggagtggctggcgtatacgaacaacctgacaagtacgcgacaatttangtctgcgtcggtgacgaaggcgtacggtcactactctacagagatagtatacgaagacgaacgacggacgtatctagacaagtagaacgagaccaacgaaaccgacgacgacgcgtacgtactagtacgtcgacgacgactacgtaccgttacgtacgttacgttacttttacgtacgtacgtcc

SEQ ID NO: 59757 - DNA, 531 bp, Homo sapiens
  misc_feature: GYAE6OF02IRVNC.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctggccgggaaagggctggagtggcttggccgtattagaaccaactgacaagtacgcgacaatttatgctgcgtcggtgcaaggcaggttcaccatctccagagatgattcagagaacacggcgtatctgacaaatagaacagacctagaaaaccgaggacacggcgtagtatacgtgtgccagacacgtccgtacgtacttacgttattttcgtagtggtaccc

SEQ ID NO: 59758 - DNA, 529 bp, Homo sapiens
  misc_feature: GYAE6OF02FOS00.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaggctggagtggcttggccgtattagaaccaaacctgacaagtacgcgacaatttatgctgcgtcggtgcaaggcaggttcaccatctccagagatgattcagagaacacggcgtatctgacaaatgaacagacctagaaaccgaggacacggccgtgtatactgtgccagacactccgtcgttacttacgtatttttctacgtggtacccg

SEQ ID NO: 59759 - DNA, 536 bp, Homo sapiens
  misc_feature: GYAE6OF02I4DOQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacgacggcgtatctgacaaatagaacagaccgtagaaaccgaggacgacggccgtgtattactgtcgcagacactccgtacgtacttacgtatttttactagttggtaccg

SEQ ID NO: 59760 - DNA, 524 bp, Homo sapiens
  misc_feature: GYAE6OF02HIY87.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaagggctggagtggcttggccgtattagaaccaacctgacaagtacgcgacaatttatgctgcgtcggtgcaaggcaggttcaccatctccagagatgattcagagaacacggcgtatctgacaaatgaacagcctagaaaccgaggacacggccgtgtattactgtgccagacatccgtcgtacttacgtatttttcagttgtacccg

SEQ ID NO: 59761 - DNA, 696 bp, Homo sapiens
  misc_feature: GYAE6OF02HJS5B.26.57.F02.1.454.CMB.1.raw
  modified_base (307)..(307): a, c, t, g, unknown or other
  misc_feature (307)..(307): n is a, c, g, or t
tcagagactatactcacgaccggtgctcgatttagctcgatatagttgggtttggggctgggagaggagctccagccttgggattcccagctgtctccactccggtgatcggcactgaagtacaagagactcaccatgggacgtttggggctgagcgtgggttttccttgttgctatttaaaaggtgtccagtgtcaggtcgcagctcggtggagtccgggggaggcttggtccagcccgggggggtccctgaaacgtctcatagtcgcaggctctggattcgaacattcacgtgactggactatanacgtgggtcccgccgagtctgccgggaaagggctcggaagtggcttggccggtattagaaccgaaacctgacaagtacgcgacaatttatgactgacggtcggtgcaagggtcgtacggtaccaacgtaactccacgacggaaggtagtagtacttacgaaggtaacgaacggtacggtacgtttaactgtacgaacaaagttaccgaaggtaacgtccgtaaaacggaaaaccggaggtaaacccggacccgggtacccgttagtttaaccgtttacggtcggtaaccggaaccgtaaacggtaccgtaccggttaccggttaaccggttaaccgtttaaaccggttttaacgtttttaacggttacggggttaccccgttaacccgg

SEQ ID NO: 59762 - DNA, 531 bp, Homo sapiens
  misc_feature: GYAE6OF02GX2TN.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaaggctggagtggcttggccgtattagaaccaaacctgacaagtacgcgacaattatgctgcgtcggtgcaaggcaggttcaccatctccagagatgatcagagaacacggcgtatctgcaaatgaacagcctagaaaccgaggacacggccgtagtacttacgtgtgccagactatccgtacgtattacgttatttttcgtagttcggtaccg

SEQ ID NO: 59763 - DNA, 519 bp, Homo sapiens
  misc_feature: GYAE6OF02INZ8G.26.57.F02.1.454.CMB.1.raw
  modified_base (259)..(259): a, c, t, g, unknown or other
  misc_feature (259)..(259): n is a, c, g, or t
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtaggctatttaaagtgtcagtgtcaggtgcagctggtggagtccgggggaggcttggtccagccgggggggtccctgaaactctcatgtgcaggctntggattcacattcagtgactcggctatatactgggtccgccagtctgccgggaaaggctggagtgctggccgtattagaaccaactgacaagtacncgacaatttatgctgcgtcggtgcaaggcaggttcaccatctccagtanatgattcagagaacacggcgtatcgtgacaaatgaacagctagaaaccgagacacgccgtgtactactgtgccagacatccgtacgttattacgtatttttacgtagtgtacccg

SEQ ID NO: 59764 - DNA, 528 bp, Homo sapiens
  misc_feature: GYAE6OF02JUYVP.26.57.F02.1.454.CMB.1.raw
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtccagccggggggtccctggaaactctcatgtgcaggctctggattcacattcagtgactcggctatatactgggtccncagtctgccgggaaaggctggagtggctggccgtatagaaccaactgacagtacgcgaacaatttangctgcgtcggtgcaaggcaggtcaccatctccagagatagattcgagagaaacacggctatctagacaaatgaacagacctagaaaccgaggacacggtccgtagtatacgtgtgaccagactactaccgtcgtattacgtattttacgagttgtaccg

SEQ ID NO: 59765 - DNA, 528 bp, Homo sapiens
  misc_feature: GYAE6OF02IVBU3.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaactgacaagtacgcgacaatttangctgcgtcggtgcaaggcaggtcaccatctccagagatgattcagagaacacggcgtatctgcaaatgaacagacctacgaaaccgaggacacggccgtgtattactgtgccagacagtccgtcgtacttacgtattttacgtagtgtacccg

SEQ ID NO: 59766 - DNA, 531 bp, Homo sapiens
  misc_feature: GYAE6OF02G1XD0.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtatagaccaaactgacaagtacgcgacaatttatgctgcgtcggtgcaaggcaggttcaccatctccagagatgattcagagaacacggcgtatctgacaaatagaacagacctagaaaccgaggacacggccgtagtattactgtcgccagacatccgtacgtacttacgtatttttcgagttggtacccg

SEQ ID NO: 59767 - DNA, 522 bp, Homo sapiens
  misc_feature: GYAE6OF02H5VC1.26.57.F02.1.454.CMB.1.raw
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtccgccagtctgccgggaaggctggagtggcttggccgtattagaaccaaactgacaagtacncgacaatttangctgcgtcggtgcaaggcaggttcaccatctccagagatgattcagagaacacggcgtatctgcaaatgaacagcctagaaaccgaggacacggacgtagtattacgtgtgccagacatccgtcgtattacgtatttttcagtgtacccg

SEQ ID NO: 59768 - DNA, 536 bp, Homo sapiens
  misc_feature: GYAE6OF02H4B6E.26.57.F02.1.454.CMB.1.raw
  modified_base (370)..(370): a, c, t, g, unknown or other
  misc_feature (370)..(370): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtaggctatttaaaaggtgtcagtgtcaggtgcagctggtggagtccgggggagcttggtccagccgggggggtcctgaaactctcatgtgcaggctctggattcacattcagtgactcggctatatactggtcccgcagtctgccgggaaaggctggagtggctggccgtattagaaccaaacctgaacaagtacgcgaacaatttangctgcgtcggtgcaaggcaggttcaccatctccagagatgattcagagaacacggcgtatctgacaaatagaacacgacctagaaaaccgaggaacgacggccgtagtattacgtgtcaccagacactccgtacgttacgttacgttatttttacgtagtgtaccg

SEQ ID NO: 59769 - DNA, 528 bp, Homo sapiens
  misc_feature: GYAE6OF02HNP3N.26.57.F02.1.454.CMB.1.raw
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccgggaaaggctggagtggcttggccgtatagaaccaactgacagtacgcgacaatttangctgcgtcggtgacgaaggcaggttcaccatctccagagatgattcagagaacacggcgtatctgacaatagaacagctagaaaccgaggacacggcgtgtattactgtgccagacactccgttcgtacttacgttatttttacgtacgtgtaccg

SEQ ID NO: 59770 - DNA, 552 bp, Homo sapiens
  misc_feature: GYAE6OF02G5O63.26.57.F02.1.454.CMB.1.raw
  modified_base (374)..(374): a, c, t, g, unknown or other
  misc_feature (374)..(374): n is a, c, g, or t
  modified_base (408)..(408): a, c, t, g, unknown or other
  misc_feature (408)..(408): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggtcgggaagggctggagtggcttggccgtattagaaccaactgacaagtacgcgacaatttangctgcgtcggtgcaaggcagtcaccatctcaganatgatcagagaacacggcgtatcgtgacaaatacgaacacgaccgtacgaaaccgacggaacgacggaccgtagtacttacgtacgtgaccacgactacgtaccgtacgttaacgttacgttactttttcgtagttcgtacccg

SEQ ID NO: 59771 - DNA, 590 bp, Homo sapiens
  misc_feature: GYAE6OF02G6CO4.26.57.F02.1.454.CMB.1.raw
  modified_base (271)..(271): a, c, t, g, unknown or other
  misc_feature (271)..(271): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggcgtttcgtcgtaggcgtacttaaagtagtcagtgtcaggtgcagctggtggagtccgggggaggcttggtccagccgggggggtccctgaaactctcatgtgcaggctctggattcanattcagtgactcggctatatctgggtccgccagtctggccgggaaggctggagtggcttggccgtatacgacaactgacaagcgcgataatttancgctgccgttgggngacgaggcgtacgtcacctntacgtacagagtatagtactacgacgaacgaacgacggtacgtactacgtacgacgtaacgtacgaacgacgaacgtaacgaaaccgaacggacgaccggtaccgtacgtacgttacgtacgtcgtaccgacgtacgtacgttaccgttacgttacgttacgtttacgttttacgttacgttacgtaccg

SEQ ID NO: 59772 - DNA, 626 bp, Homo sapiens
  misc_feature: GYAE6OF02FFT5P.26.57.F02.1.454.CMB.1.raw
  modified_base (304)..(304): a, c, t, g, unknown or other
  misc_feature (304)..(304): n is a, c, g, or t
  modified_base (391)..(391): a, c, t, g, unknown or other
  misc_feature (391)..(391): n is a, c, g, or t
tcagagactatactcacgaccggtgctcgatttagctcgatatagttgggttggggctgggagaggagctccagccttgggattcccagctgtctccactcggtgatcggcactgaatacaagagactcaccatggagttgggctgagctgggttttcctgttgctattttaaaaggtgtccagtgtcaggtgcagctggtggagtccgggggagcttggtccgaggccgggggggtccctgaaactctcatgtgcaggctctggattcacattcagtgactcggctatatactcggggtcccncctagtcgtggaccgggaaagggctgggagtggcttggccgttaattaacgaaccaaacctgaacaaggtacgcgtaactaatttangctgcgtcggtgacaaggcacggttcacctatcctaccgagacgtatagacttacgaagaacgaaccgacggtcgtactcgtagaacaaagtagaaccgacgtacccgtaacggaaaacccggacggtaaccggaccgggtccgttagttacttacgtcggtacgaccgaacgtacctacgttacccggttacgttaacgtttacgtttactttttccgacggttccggtacccg

SEQ ID NO: 59773 - DNA, 529 bp, Homo sapiens
  misc_feature: GYAE6OF02F646E.26.57.F02.1.454.CMB.1.raw
  modified_base (373)..(373): a, c, t, g, unknown or other
  misc_feature (373)..(373): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggttccctgaactctcatgtgcaggctctggattcacattcagtgactcggctatatactgggtccgccagtctgccgggaaggctggagtggcttggccgtattagaaccaaacctgacaagtacgcgacaatttangctgcgtcggtgcaaggcaggttcaccatctccagagatgattcagagaacacggcgtatctgacaaatgaacagacctagaaaccgaggacgacggccgtagtacttactgtgccagacactccgtcgtacttacgtatttttcagttgtacccg

SEQ ID NO: 59774 - DNA, 538 bp, Homo sapiens
  misc_feature: GYAE6OF02HTHHF.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttctgttgctattttaaaggtgtccagtgtcaggtgcagctggtggagtccgggggaggcttggtccaggccgggggggtccctggaaactctcatgtgcaggctctggattcacattcagtgactcggctatatactgggtccgccagtctgccgggaaggctggagtggcttggccgtattagaaccaactgacaagtcgacgactaatttatgctgcgtcggtgcaaggctagttcgacatctccagagatgattcagagaacacggacgtatctagacaaatagaacagacctacgaaacgaggacacggcgtagtagttactgtcgtccagacacgtccgtacgtacgttaacgttagttttttctacgtggtaccg

SEQ ID NO: 59775 - DNA, 561 bp, Homo sapiens
  misc_feature: GYAE6OF02HBT6B.26.57.F02.1.454.CMB.1.raw
  modified_base (370)..(370): a, c, t, g, unknown or other
  misc_feature (370)..(370): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttccgtgtggctatttaaaaggtgtccagtgtcaggtgcagctggtggagtccgggggagcttggtccaggccggggggtccctgaactctcatgtgcaggctctggattcacattcagtgactcggctatatactgggtccgccagtcgtgccgggaaaggctggagtggcttggcgtatagaaccaaactgaacaagtacgcgacaatttangctgcgtggtgacaaggcgtaggttcaccgatctccagagatgaattcaagacgaaacgacggacgtatacgtagacaaatagaaacgagacctaagaaaaccgacggaaccgaccggcgttagtattacgtggtacgccagacacgtaccgtacgttacttacgttatttttacgtagttacggtacccg

SEQ ID NO: 59776 - DNA, 538 bp, Homo sapiens
  misc_feature: GYAE6OF02GH16G.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaaggcaggttcaccatctccagagatgattcagagaacgacggacgtatctgacaaatagaacagacctagaaaccgaggacgacggccgtagtacttactgtcgccagacactaccgtcgttacttacgtatttttctagtgtacccg

SEQ ID NO: 59777 - DNA, 543 bp, Homo sapiens
  misc_feature: GYAE6OF02GCDBN.26.57.F02.1.454.CMB.1.raw
  modified_base (302)..(302): a, c, t, g, unknown or other
  misc_feature (302)..(302): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccnccagtctgccgggaaaggctggagtggcttggccgtattagaaccaaactgacaagtacgcgacaatttatgctgcgtcggtgcaaggcaggttcaccatctccagagatgattcagagaacacggacgtatctgacaaatagaacacgacctacgaaaccgacggaacgacggaccgtagtattactggtcgccagacactccgtcgttacttacgttatttttacgagttcggtacccg

SEQ ID NO: 59778 - DNA, 541 bp, Homo sapiens
  misc_feature: GYAE6OF02I7BMD.26.57.F02.1.454.CMB.1.raw
  modified_base (301)..(301): a, c, t, g, unknown or other
  misc_feature (301)..(301): n is a, c, g, or t
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaggtgtccagtgtcaggtgcagctggtggagtccgggggaggcttggtccagccgggggggtccctgaaactctcatgtgcaggctctggattcacattcagtgactcggctatatactgggtccnccagtctggccgggaaagggctgggagtggcttggccgtattacgaaccaacctgacaagtacgcgactaatttangctgcgtcggtgcaaggcaggtcaccgatctccagagatgtattcagaagaacgacggcgtatctgacaaatagaacagacctagaaaccgaggacacggcgtagtagttactggtgaccagacactcgtacgttattacgttattttacgtagttcgtacccg

SEQ ID NO: 59779 - DNA, 558 bp, Homo sapiens
  misc_feature: GYAE6OF02FII5Z.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtcccgccagtctggccgggaaagggctggagtggcttggccgtattagaaccaaactgacaagtacgcgacaatttangctgcgtcggtgcaaggcaggttcaccatctccagagatgatcagagaacgacggcgtatctagacaaatagaacacgaccgtacgaaaaccgacggaacgaccggacgtagttattactggtcgaccgacgacacgtaccgtacgttacgttaccgttatttttacgtagttcgtacccg

SEQ ID NO: 59780 - DNA, 546 bp, Homo sapiens
  misc_feature: GYAE6OF02I111J.26.57.F02.1.454.CMB.1.raw
  modified_base (527)..(527): a, c, t, g, unknown or other
  misc_feature (527)..(527): n is a, c, g, or t
tcagagactatactcacgaccggtgctcgatttagctcgatatagttggggtttgggggctgggagaggagctccagccttggggattcccagctgtctccactccggtgatcggcactgaatacaagagactcaccagtggagtttgggctgagctgggtttccttgttgctattttaaaaggtgtccagtgtcaggtgcagctgggtggagtccgggggaggcttgggtccaggccgggggggtccctggaaactctcatgtgcaggctctggattcacgattcagtgacgtcgggctatatactgggtcccgccagtctgcccgggaaagggctggacgtggcttggccgtattacgaaccaacctgacaagtacgcgacaatttatgctgcgtcggtgcaaggcaggtcaccatctccagagatgattcagaagaacgacggcgtatctgacaaatagaacagcctacgaaaccgaggacgacggcgtagtatacgtgtgccagacactcgtcgtattacgtntttttacgtagtgtacccg

SEQ ID NO: 59781 - DNA, 528 bp, Homo sapiens
  misc_feature: GYAE6OF02IP5SY.26.57.F02.1.454.CMB.1.raw
  modified_base (434)..(434): a, c, t, g, unknown or other
  misc_feature (434)..(434): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggagcttggtccagccggggggtccctgaaactctcatgtgcaggctctggattcacattcagtgactcggctatatactgggtccgccagtctgccgggaaaggctggagtggcttggccgtattagaaccaaactgacaagtacgcgacaatttatgctgcgtcggtgcaaggcaggttcaccatctccagagatgattcagagaacacggacgtatcngacaaatgaacacgcctagaaaaccgaggaacacggccgtagtattactgtgaccagacatccgtcgtattacgtatttttctagtggtacccg

SEQ ID NO: 59782 - DNA, 542 bp, Homo sapiens
  misc_feature: GYAE6OF02JJU3K.26.57.F02.1.454.CMB.1.raw
  modified_base (451)..(451): a, c, t, g, unknown or other
  misc_feature (451)..(451): n is a, c, g, or t
tcagagactatactcacgaccggtgctcgatttagctcgatatagttgggtttggggcgtgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaaggctggagtggcttgggccgtatagaaccaaactgacaagtacgcgacaatttatagctagcgttcgggtgcaaggctaggttcaccatactccagagatgatcagacgaacacggcgtatctgacaagtnaacagacctagaaaccgaggaccacggccgtagtattacgtgtacgccagacagtccgtacgttattacgttatttttactagtcgtaccg

SEQ ID NO: 59783 - DNA, 532 bp, Homo sapiens
  misc_feature: GYAE6OF02INPFN.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgacaaatagaacagacctagaaaccgaggacacggccgtagtattactgtgccagacactccgtcgtacttacgtatttttacagttgtacccg

SEQ ID NO: 59784 - DNA, 536 bp, Homo sapiens
  misc_feature: GYAE6OF02HJQ90.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaaaggctggagtggcttggccgtattagaaccaaactgacaagtacgcgacaatttangctgcgtcggtgcaaggcaggttcaccatctcagagatgattcagacgaacgacggcgtatctgacaaatagaacacgacctacgaaaccgaggacgacggccgtagtattactgtgccagacagtccgtacgtacttacgttatttttctagtgtacccg

SEQ ID NO: 59785 - DNA, 528 bp, Homo sapiens
  misc_feature: GYAE6OF02G3TSP.26.57.F02.1.454.CMB.1.raw
tcagagactatactcacgaccggtgctcgatttagctcgatatagttgggtttggggctgggagaggagctccagccatgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagacctagaaaccgaggacgacgccgtgtattacgtgtagccagacactccgtcgttattacgtatttttctagttccgg

SEQ ID NO: 59786 - DNA, 540 bp, Homo sapiens
  misc_feature: GYAE6OF02IINTX.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaacctgacaagtacgcgacaatttangctgcgtcggtgcaaggcaggtcaccatctccagagatgatcagagaacacggcgtatctagcaaatagaacagacctagaaaccgaggaccgacggccgtagtattacgtgtcgaccagacacgtccgtacgttacgttacgtacgtttttctacggtgtacccg

SEQ ID NO: 59787 - DNA, 583 bp, Homo sapiens
  misc_feature: GYAE6OF02F3W87.26.57.F02.1.454.CMB.1.raw
  modified_base (154)..(154): a, c, t, g, unknown or other
  misc_feature (154)..(154): n is a, c, g, or t
  modified_base (379)..(379): a, c, t, g, unknown or other
  misc_feature (379)..(379): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggnggtttcgtctaggctattaaagtgtcagtgtcagtgcagctggtggagtccgggggaggcttggtccagccgggggggtccctgaaactctcatgtgcaggctctggattcacattcagtgactggctatatactgggtccgccagtctgccggaaagggctggagtggcttggccgtattagaaccaaacctgacaagtacgcgacaattatgctgcgttcggngacgagcagtcactatctcgagagatgtatcagaagaacgacggacgtactctagacaaatagtaacacgtaccgtaacgaaaaccggtaacggaaaccgaacggtaccgtagtacgttacgtcggtacgtaccgaacgtaacctacgttaccgttaccgttaacgtttaaccgtttacgtttttaccgtaggttcggtacccg

SEQ ID NO: 59788 - DNA, 528 bp, Homo sapiens
  misc_feature: GYAE6OF02F4SKS.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaaggcaggttcacatctcagagatgattcagagaacacggcgtatctgcaaatgaacagctagaaaccgaggacacggccgtgtattacgtgtgaccagaccatccgtcgttacttacgttatttttcagttgtacccg

SEQ ID NO: 59789 - DNA, 544 bp, Homo sapiens
  misc_feature: GYAE6OF02II5U1.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtccagccgggggggtccctgaaactctcatgtgcaggctctggattcacattcagtgactcggctatatactgggtcccgcagtctggccgggaagggctggagtggcttggccgtattagaaccaaactgacaagtacgcgacaatttangctgcgtcggtgcaaggcaggttcaccatctccagagatgattcagaagaacgacggacgtatctagacaaatagaacagaccgtaagaaaccgaggaacgacgaccgtagtattacgtgtcgccacgacactaccgtacgttacttacgtatttttctagttgtacccg

SEQ ID NO: 59790 - DNA, 525 bp, Homo sapiens
  misc_feature: GYAE6OF02GW5FY.26.57.F02.1.454.CMB.1.raw
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (444)..(444): a, c, t, g, unknown or other
  misc_feature (444)..(444): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccnccagtctgccgggaaagggctggagtggcttggccgtattagaaccaaacctgacaagtacgcgacaatttangctgcgtcggtgcaaggcaggttcaccatctccagagatgattcagagaacacggcgtatctgcaaangaacagctagaaaccgaggacacggccgtgtattactgtcgccagacactcgtcgtattacgtatttttctagtgtacccg

SEQ ID NO: 59791 - DNA, 567 bp, Homo sapiens
  misc_feature: GYAE6OF02GYBNA.26.57.F02.1.454.CMB.1.raw
  modified_base (382)..(382): a, c, t, g, unknown or other
  misc_feature (382)..(382): n is a, c, g, or t
  modified_base (455)..(455): a, c, t, g, unknown or other
  misc_feature (455)..(455): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttgggtccaggccgggggggtccctggaaactctcatgtgcaggctctggattcacattcagtgactcggctatatactgggtccgccagtctggccgggaaagggctggagtggcttggccgtatacgaaccaaactgacaagtacgcgaactaatttangctgcgtcgggtgacgaaggcgaggtacacctatctccagagatgatcagagaacacgcgtatctagacaaanagaacacgacctacgaaaaccgaacggaacgaaccgggaccgtagtacgttacgtgtcgaccgagacacgtaccgtacgttacttacgttatttttacgtagttcggtaccg

SEQ ID NO: 59792 - DNA, 532 bp, Homo sapiens
  misc_feature: GYAE6OF02IZIGC.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcgaaggcaggttcaccatctccagagatgattcgagagaacacggacgtatctgcaaatagaacagactagaaaccgaggacacggaccgtgtattactgtcgaccagactactccgtcgtattacgtatttttctagtggtaccc

SEQ ID NO: 59793 - DNA, 524 bp, Homo sapiens
  misc_feature: GYAE6OF02IPEGJ.26.57.F02.1.454.CMB.1.raw
  modified_base (370)..(370): a, c, t, g, unknown or other
  misc_feature (370)..(370): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcttggtcagccggggggtccctgaaactctcatgtgcaggctctggattcacattcagtgactcggctatatactgggtcctcagtctgccgggaaaggctggagtggcttggccgtattagaaccaaactgacaagtacgcgacaatttangctgcgtcggtgcaaggcaggttcaccatctccagagatgattcagagaacacggcgtagtctgacaaatagaacagctagaaaaccgaggacacggccgtagtattactgtgacagacacgtcgtacgtattacgtatttttcgagtgtaccg

SEQ ID NO: 59794 - DNA, 537 bp, Homo sapiens
  misc_feature: GYAE6OF02HFW9G.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctcgtggattcacattcagtgactcggctatatactgggtccgccagtctgccgggaagggctggagtggcttggccgtattagaaccaaacctgacaagtacgcgacaatttangctgcgtcggtgcaaggcaggttcacactctccagagatgattcagagaacacggcgtatctgacaaatagaacacgcctagaaaccgaggacgacggccgtagtattacgtgtcgccagacactccgtacgtacttacgtatttttcgagttcgtacccg

SEQ ID NO: 59795 - DNA, 543 bp, Homo sapiens
  misc_feature: GYAE6OF02G91SG.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaagggctgggagtggcttggccgtattacgaaccaaactgacaagtacgcgactaattangctgcgtggtgcaaggcaggtcaccatctccagagatgattcagagaacgacggcgtatctgcaaatagaacgacgaccgtacggaaaaccgacggaacgaccggaccgtagtacttacgtgtcgccagactactccacttcgtacttacgtatttttcagttccgg

SEQ ID NO: 59796 - DNA, 561 bp, Homo sapiens
  misc_feature: GYAE6OF02HS45P.26.57.F02.1.454.CMB.1.raw
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (443)..(443): a, c, t, g, unknown or other
  misc_feature (443)..(443): n is a, c, g, or t
tcagagactatactcacgaccggtgctcgatttagctcgatatagttgggtttggggctggggagaggagctccagccttgggattcccagctgtctccactcggtgatcgacactgaatacaagagactcaccatggagtttgggctgagctggttttccttgttgctattttaaaaggtgtccagtgtcaggtgcagctggtggagtccgggggaggcttggtccaggccgggggggtccctgaaactctcatgtgcagctctggattcacattcagtgactcggctatatacgtggtccgcagtctggccgggaaggctgggagtggcttggccgtattaggaaccaaacctgacaagtacgacgactaatttatgctgcgtcggtgcaaggcaggttcaccatctcaganatgtatnagagaacacggactagtctganaaagtagaacagacctaacgaaaccgaaggaacgaaccggtcgtacgtagttactcggtacgaccagaactacgtccgttcgttacttacgttactttttactacggttcgtacccgg

SEQ ID NO: 59797 - DNA, 692 bp, Homo sapiens
  misc_feature: GYAE6OF02FMEVP.26.57.F02.1.454.CMB.1.raw
  modified_base (209)..(209): a, c, t, g, unknown or other
  misc_feature (209)..(209): n is a, c, g, or t
  modified_base (275)..(275): a, c, t, g, unknown or other
  misc_feature (275)..(275): n is a, c, g, or t
  modified_base (376)..(376): a, c, t, g, unknown or other
  misc_feature (376)..(376): n is a, c, g, or t
tcagagactatactcacgaccggtgctcgatttagctcgatatagttgggtttggggtctgggagaggagcctcccacgccttgggattcccagcctgtcgtcccgactcggtgatcggcgactcgtaagttacggaagaggaactcaccagtccggagtttgggctgaagcggtggttccgtcgtacggcgtcttaaagtgtcgagtnctagtgcagtgtggtggagtacgggcgtcggtcgtccaggtcgggggtacctcgaacctcgcagtntgacgtacgccttccagtattcgatactacgtggtcgactcggtacgtacctgtaccgtaggggtccctacgagtcgtaggccggggaaggcgtaggtcgnggctacggtacctaattaacgaaccaactacgtaacctaagtacgaccaacgaatttaacgtcgacggtcgcggttacggtcgaaccgtaggaccgtacggtacaccgtacttccgacgacgacgactacgaccttagagtaggtaaccgtaggacgtacgtcgtagaacgtaagtacgaacgacgtaccgaccgggtaaacccggtaagtaccgtacgggcgttacgttacgtagtacgttacaccgtaacgtagttacgttaaccgtcggttacttaaccggttcggttttaccggacgggttcccgtacccgg

SEQ ID NO: 59798 - DNA, 623 bp, Homo sapiens
  misc_feature: GYAE6OF02GUZSB.26.57.F02.1.454.CMB.1.raw
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccnccagtctggccgggaaagggctggagtggcttggccgtattacgaaccaaacctgaacaagtacgcgaacaatttangactgcgtcggtgcgaaggcaggtcaccactctcagagatgattcagaacgaacacggacgtatcgtacgacaaatacggaaacaacgtacccgtaacgaaaaccgaacgggaaccgtaaccgggtaccggtacgttacgtttacgtacggttacgacccgtaacggaaccgtaacgttacccggttaaccggttaactttaacggtttactttttttaccgtacggtttcggttaaccccgg

SEQ ID NO: 59799 - DNA, 534 bp, Homo sapiens
  misc_feature: GYAE6OF02G8C7H.26.57.F02.1.454.CMB.1.raw
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccnccagtctgccgggaaagggctggagtggcttggccgtattagaaccaaacctgacaagtacgcgacaatttangctgcgtcggtgcaaggcaggtcaccatctccagagatgattcagagaacacggcgtatctgcaaatagaacagacctagaaaaccgaggaacacggccgtagtattacgtgtgccagacagtccgtcgtacttacgtatttttacagttggtacccg

SEQ ID NO: 59800 - DNA, 705 bp, Homo sapiens
  misc_feature: GYAE6OF02F3U3P.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccgggggggtactcccgtagaaactctactagtgtcgcgacggcttcgtggtacttcactattcgagtcgacgtcggtctatatacgtcgggtcccgcgtagtcgtcggaccggggaaaggcgtgggaggtcggtcgttcgggtccgttaagttaacgaaaaccctaaaccgtagaaaccgtaaacggtaccggacgaaacttaaattttagtcgtcgttacggtccgggttacggtcgaacggaacgggacgtacggttacccaaccgtacgtcccgtaccgaagtaagtagtacgtacttacgaaggaacgaacggacggtcgtactcgtacgaactaaagtacgaacgacgacctaaacggaaaaccgagaaccgaccggtacgttagttaacgtacgtggtaccgacgaacgtaacgtacgttccggttacgttaacgttacgtttacgtttttacgacggtttacccgg

SEQ ID NO: 59801 - DNA, 542 bp, Homo sapiens
  misc_feature: GYAE6OF02JF4BN.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttggtccagcggggggtcctgaactctcatgtgcaggctctggattcacattcagtcggactcgctatagtactggtcgccagtcgtaggccggaagggctggagtggcttggcgtatacgaacaacctagacagtacagtacaattatgctgcgtcgtagcaaggcacgtcacatactcagagatgatacagagaacacgcgtatactagacaaatagaacacgaaccgtagaaaccgaacggacgacgaccgtagtacgttacgtacgtagacgacgtacgtacgtaccgtacgtacttacgtacgttttacgtacgtacg

SEQ ID NO: 59802 - DNA, 565 bp, Homo sapiens
  misc_feature: GYAE6OF02GF4EL.26.57.F02.1.454.CMB.1.raw
  modified_base (303)..(303): a, c, t, g, unknown or other
  misc_feature (303)..(303): n is a, c, g, or t
  modified_base (382)..(382): a, c, t, g, unknown or other
  misc_feature (382)..(382): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccnccagtctgcccgggaaagggctgggagtggcttggccgtattacgaaaccaaacctgacaagtacgcgaactaatttangctgcgtcggtgacaaggcaggttcacatcctcagagatagatcgagacgaacacggacgtatcgtacgacaaacgtagaacacgacctagaaaaccgaaggaccgacggaccgtagtacttactgtcgacctagacactaccgtacgttacttaaccgttagtttttctaggtcggtacccg

SEQ ID NO: 59803 - DNA, 536 bp, Homo sapiens
  misc_feature: GYAE6OF02I8JKB.26.57.F02.1.454.CMB.1.raw
  modified_base (380)..(380): a, c, t, g, unknown or other
  misc_feature (380)..(380): n is a, c, g, or t
  modified_base (440)..(440): a, c, t, g, unknown or other
  misc_feature (440)..(440): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccggggaaagggctgggagtggcttggccgtattacgaaccaaacctgacaagtacgcgacaatttangctgcgtcggtgcaaggcaggtcaccatctcagagatgattcagagaacacggcgtatcngacaatagaacagacctagaaaccgaggacgacggccgtagtatactgtcgacacgacacgtccgtcgtattacgtatttttctagttcgtacccg

SEQ ID NO: 59804 - DNA, 531 bp, Homo sapiens
  misc_feature: GYAE6OF02GRSJ8.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgaacaatttangctgcgtcggtgcaaggcaggttcaccatctccagagatgattcagaagaacacggcgtatctgcaaatagaacagcctagaaaaccgaggacacggccgtgtattactgtcgacagacatccgttacgtattatgtatttttcgtagttacgg

SEQ ID NO: 59805 - DNA, 552 bp, Homo sapiens
  misc_feature: GYAE6OF02IWARX.26.57.F02.1.454.CMB.1.raw
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagtcgggggggtccctgaaactctcatgtgcaggctctggattcacattcagtgactcggctatatactgggtccnccagtctgccgggaaagggctggagtggcttggccgtattagaaccaaactgacaagtacgcgacaatttangctgcgtcggtgcaaggcaggtcacatctccagagatgattcagagaacacggcgtatctagacaaatacgaacacgaccgtacgaaaaccgaggaaccaacgggaccgtacgtagttacgtgtcgccagacacgtaccgtacgttacttacgttatttttacgtagttcgtacccg

SEQ ID NO: 59806 - DNA, 613 bp, Homo sapiens
  misc_feature: GYAE6OF02H834T.26.57.F02.1.454.CMB.1.raw
  modified_base (381)..(381): a, c, t, g, unknown or other
  misc_feature (381)..(381): n is a, c, g, or t
tcagagactatactcacgaccggtgctcgatttagctcgatatagttgggtttggggctgggagaggagctccagcccttgggattcccagctgtctccactcggtgatcggcactgaatacaagagactcaccatggagtttgggctgagctgggttttccttgttgctattttaaaaggtgtccagtgtcaggtgcagctggtgggagtccgggggaggcttggtccgaggccgggggggtccctgaactctcatgtgcaggctctggattcacattcagtgactcggctatatacgtgggtcccgccagtctggccgggaaggctgggagtggcttggccgtattagaaccaaactcgacaagtacgcgacaatttanagctgcgtcggtgcgaggcgaggttcaccatctccgagagagtagtattacgaagacgaacgacggtacgtatctgacaaagtacgaacaacgaccgtaacggaaaaccgacgggaacgaccgggtacccggtagttacgttacgttacggtacgaccgacgaacctacgtacccggttacgttaacgtttaaccgtttacgttttttacgtacggtttacggttaacccgg

SEQ ID NO: 59807 - DNA, 569 bp, Homo sapiens
  misc_feature: GYAE6OF02GWELY.26.57.F02.1.454.CMB.1.raw
  modified_base (311)..(311): a, c, t, g, unknown or other
  misc_feature (311)..(311): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttgggtccaggccgggggggtccctgaaactctcatgtgcaggctctggattcacattcagtgactcggctatatactgggtccgcagtcnggccgggaaagggctggagtggcttggccgtattagaaccaactgacgaagtacgacgactaatttatgctggcgtcggtgcaaggcaggttcaccatctccagagatgtatcaagacgaacgacggtacgtactctagacaaagtacgaacgacgacctaacggaaaccggaacggaacgaaccggaccgtagtattacgtaggtcgaccaacgacacgtcgtacgttacttacgttatttttcgtagttcgtaccg

SEQ ID NO: 59808 - DNA, 560 bp, Homo sapiens
  misc_feature: GYAE6OF02F6K44.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccgggggggtccctgaaactctcatgtgcaggctctggattcacattcagtgactcggctatatacgtgggtccgtcagtctggccgggaaagggctggagtggcttggccgtattagaaccaactgacagtacgcgacaattatgctgcgtcggtgcgaaggcaggtcacgatctcgagagatgtatcagagaacgacggcgtatctagacaaagtagaacacgacctaagaaaccgacggacgaccggtaccgtagtacgttacgtgtcgaccgagactacgtccgttacgttacgttaccgttatttttacgtacgttcgtacccg

SEQ ID NO: 59809 - DNA, 559 bp, Homo sapiens
  misc_feature: GYAE6OF02GK8FW.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgaccgggaaaggctggagtggcttggccgtagttagaaccaaactgaacaagtacgcgaacaatttangctgcgtcggtgcaaggcaggttcacatcaccagagatgattcaagtagaacgacggtcgtatctagacaaatagaacacgacctagaaaaccgaggaaccgacggaccgtagtacttacgtacgtcgaccgagacacgtaccgtacgttacgttacgttatttttacgtagttcgtacccg

SEQ ID NO: 59810 - DNA, 566 bp, Homo sapiens
  misc_feature: GYAE6OF02H0D1B.26.57.F02.1.454.CMB.1.raw
  modified_base (304)..(304): a, c, t, g, unknown or other
  misc_feature (304)..(304): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttccgttgttaggctatttaaaaggtgtccagtgtcaggtgcagctggtggagtccgggggaggcttggtccagccgggggggtccctgaaactctcatgtgcaggctctggattcacattcagtgactcggctatatactgggtccncagtctgccgggaaggctggagtgcttggcgtatacgaaccaaacctgacgaagtacgacgaactaatttatgctgcgtacggtgcgaaggccaggttcaccatctaccgagagatgattcagtagaacacggngtaanctaggacaaatagaacagacctaagaaaccgaggacacgggaccgtgtacttacgtagtcgtacgacaacgacgttcgttaccggttattaaccgttagtttttactttacgtagttacccgg

SEQ ID NO: 59811 - DNA, 579 bp, Homo sapiens
  misc_feature: GYAE6OF02II1H5.26.57.F02.1.454.CMB.1.raw
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (443)..(443): a, c, t, g, unknown or other
  misc_feature (443)..(443): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccaggtctggccgggaaggcgtggagtggcttggccgtattagaaccaaactgacaagtacgngactaatttangctgcgtcggtgacgaaggcaggtcaccatctccagagatagattacagagaacacggcgtatcncgacaaatacgaacacgaccgtaacgaaaaccgacggaacgaccggaccgtagttacttacgtcggtacgaccgagaacgtacgttaccggtcgttacgtttaccgttagttttttacgtacgttacggttacccg

SEQ ID NO: 59812 - DNA, 624 bp, Homo sapiens
  misc_feature: GYAE6OF02GUTPD.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctgggagtggcgttggccgtattacgaaccaaactgacaagtacgcgacaatttangtctgcgtcggtgcaaggcaggttcaccatctccgagagtatgtattcaagacgaacgacggacgtacgtcgtagacaaagtacgaacgacgaccgtaacgaaaacccgaacgggaaccgaaccgggtacccgttacgttacgtttacgttacggtacggtacccgaacggtaacctacgttacccggttaccgttacgtttaaccggtttaacgtttttttaccgtacggtttacggttaacccgg

SEQ ID NO: 59813 - DNA, 547 bp, Homo sapiens
  misc_feature: GYAE6OF02FR7NK.26.57.F02.1.454.CMB.1.raw
  modified_base (269)..(269): a, c, t, g, unknown or other
  misc_feature (269)..(269): n is a, c, g, or t
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgttgctatttaaaggtgtccagtgtcaggtgcagctggtggagtccgggggaggcttggtccaggccggggggtccctgaaactctcatgtgcaggctctggattcacnttcagtgactcggctatatacgtgggtcccgccagtctggccgggaagggctgggagtggcttggccgtatagaaccaactgaacagtacgcgactaatttangctgcgtcggtgcgaaggcgagtcaccatctccagagatgtatcagagacacggcgtatctagacaatagaacagactaacgaaaccgaggacgacggaccgtagttacgtactagtcgaccaagtactacgtccgttacgttacttaccgttatttttacgtagttcgtacccg

SEQ ID NO: 59814 - DNA, 528 bp, Homo sapiens
  misc_feature: GYAE6OF02H1R9P.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaactgacaagtacgcgacaatttangctgcgtcggtgcaaggcaggtcaccatctcagagatgattcagagaacacggcgtatctgcaaatagaacagacctagaaaccgaggaacacggaccgtgtattactgtgccagacactaccgtcgtacttacgtatttttcagttggtccc

SEQ ID NO: 59815 - DNA, 532 bp, Homo sapiens
  misc_feature: GYAE6OF02F3OCS.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaagggctggagtggcttggccgtattagaaccaaactgacaagtacgcgacaatttatgctgcgtcggtgcaaggcaggttcaccatctccagagatgattcagagaacacggcgtatctgacaaatagaacagacctagaaaccgaggaacgacggccgtgtacgttactgtcgacagacactccgtacgtattacgtatttttcagtgtacccg

SEQ ID NO: 59816 - DNA, 533 bp, Homo sapiens
  misc_feature: GYAE6OF02IXG20.26.57.F02.1.454.CMB.1.raw
  modified_base (370)..(370): a, c, t, g, unknown or other
  misc_feature (370)..(370): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctatttaaaaggtgtccagtgtcaggtgcagctggtggagtccgggggaggcttggtccagccggggggtccctgaactctcatgtgcaggctctggattcacattcagtgactcggctatatactgggtccgccagtctgccgggaaagggctggagtggcttggccgtatagaccaaacctgacaagtacgcgacaatttangctgcgtcggtgcaaggcaggtcaccatctccagagatgattcagagaacacggcgtatctgacaaatagaacagactagaaaccgaggaacgacggcgtagtactacgtgtcgaccagacgtactccgtcgtacttacgtatttttacgtaggtcgtacccg

SEQ ID NO: 59817 - DNA, 623 bp, Homo sapiens
  misc_feature: GYAE6OF02I9J5B.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctcgtggattcacattcagtgactcggctatatactgggtcccgccgagtcgtggccgggaaagggcgtggagtcggtcgttgggccgtagttaacgaacctaaaccgtgaacaaaggtaccgacgaactaattttagtgtactgcggttcggtgacgaacggcgtacggttaccaccgtactcctaccgagacgatgtacttacgagagaacgacggtcgtatctagacaaatagaacacgaccgtacgaaaccgaacggacgaccggtaccgttagtacgttacgtacgtcgaccgacgaccgtacgttaccgttacgttaacgtttacgttacgttttttacgtacgttcggttacccg

SEQ ID NO: 59818 - DNA, 592 bp, Homo sapiens
  misc_feature: GYAE6OF02H94S7.26.57.F02.1.454.CMB.1.raw
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaaggctggagtggctggccgtattagaaccaaactgacaagtacgcgacaatttangcttgcgtcggtgcaaggcaggttcacctatctccagagatcgatcagagaacgacggcgttactctagacaaagtacgaacagaccgtagaaaaccgtacgggaacgaccgggtaccgtcgttattaacgtcggtacgtaccgacgtaacgtaacgttcccgttaccggttaacgtttaaccgttaactttttttccgtacggttacggttaaccccgg

SEQ ID NO: 59819 - DNA, 559 bp, Homo sapiens
  misc_feature: GYAE6OF02HJYWK.26.57.F02.1.454.CMB.1.raw
  modified_base (382)..(382): a, c, t, g, unknown or other
  misc_feature (382)..(382): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccgggaaagggctggagtggcgttggccgtattacgaaccaaacctgacaagtacgacgaactaatttangctgcgtcggtgcgaaggcaggttcaccatctaccagagatgattcgagagaacacggcgtatactgacaaagtagaacagaccgtagaaaccgaggacgacggcgtagtacttacgtgtcgccagactacgtccgtacgttacgttacgttagtttttacgtacgttcggtacccg

SEQ ID NO: 59820 - DNA, 546 bp, Homo sapiens
  misc_feature: GYAE6OF02IZA0Y.26.57.F02.1.454.CMB.1.raw
  modified_base (413)..(413): a, c, t, g, unknown or other
  misc_feature (413)..(413): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcactattcagtgactcggctatatactgggtccgccagtctggccgggaagggctgggagtggcttggccgtatacgaaccaactgacaagtacgacgactaattatgctgcgtcggtgcaaggcagtcaccatctcagagatnatcagagaacgacgcgtactctacgacaatagaacacgacctacgaaaccgaggaacgacgcgtagtacgttacgtgtcgaccacgactactccggtacgttacgttacgtagtttttactagttcgtacccg

SEQ ID NO: 59821 - DNA, 551 bp, Homo sapiens
  misc_feature: GYAE6OF02GGC6Y.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaggctggagtggcttggccgtattagaaccaaacctgacaagtacgcgacaatttatgctgcgtcggtgacaaggcaggtcacatctccagagatgacttacagaagaacgaacggcgtatctagacaaatgaacacgcctagaaaaccgaggaccgacggaccgtagtacttacgtgtcgaccacgacgacttccgtacgttagttaccgttatttttctagtcggttacccg

SEQ ID NO: 59822 - DNA, 540 bp, Homo sapiens
  misc_feature: GYAE6OF02HH7MX.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaaaggctggagtggcttggccgtattagaaccaaacctgacaagtacgcgacaatttangctgcgtcggtgcaaggcaggtcaccatctccagagatgattcagagaacacggcgtatctagacaaatagaacagcctagaaaccgaggacacggccgtagtattactggtcgccagacactccgtacgttacttaccgttatttttactagttcggtacccg

SEQ ID NO: 59823 - DNA, 568 bp, Homo sapiens
  misc_feature: GYAE6OF02HVDWA.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaaggctggagtggcttggccgtattagaaccaaactgacaagtacgcgacaatttangctgcgtcggtgcaaggcaggtcacatctcagagatgatcagagaacgacggcgtatctagacaaatagaacacgaccgtacgaaaaccgacggaacgacgggaccgtagtacgtttacgtacggtcgtaccacgacctacgtaccgttacgttacgtttaacgttacttttttacgtacggttcggtacccg

SEQ ID NO: 59824 - DNA, 540 bp, Homo sapiens
  misc_feature: GYAE6OF02F2K3X.26.57.F02.1.454.CMB.1.raw
  modified_base (324)..(324): a, c, t, g, unknown or other
  misc_feature (324)..(324): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgcgggaaaccgggntggagtggcttggccgtattagaaccaaacctgacaagtacgcgacaatttatgctgcgtcggtgcaaggcaggttcaccatctcagagatgattcagagaacacggacgtatctgacaaatagaacagcctacgaaaccgacggaacgaccggccgtagtacttactgtcgccagacagtccgtcgtacttacgtatttttctagttcgtacccg

SEQ ID NO: 59825 - DNA, 539 bp, Homo sapiens
  misc_feature: GYAE6OF02FUZCZ.26.57.F02.1.454.CMB.1.raw
  modified_base (370)..(370): a, c, t, g, unknown or other
  misc_feature (370)..(370): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccagccggggggtcctgaaactctcatgtgcaggctctggattcacattcagtgactcggctatatactgggtccgccagtctgccgggaaagggccggagtggcttggccgtatagaaccaactgacaagtacgcgacaatttangctgcgtcggtgcaaggcagtcaccatctccagagatgattcagagaacacggcgtatctgacaaatcgaacagacctacgaaaccgagacgacggccgtagtacttactgtcgccagacgtacgtccgtacgttacttacgttactttttcacgttcgtaccctacgg

SEQ ID NO: 59826 - DNA, 541 bp, Homo sapiens
  misc_feature: GYAE6OF02HQE7N.26.57.F02.1.454.CMB.1.raw
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctgaactctcatgtgcaggctctggattcacattcagtgactcggctatatactgggtccgccagtctggccgggaaaggctggagtggcttggccgtatagaaccaactgacaagtacgacgactaattangctgcgtcggtgcaaggcgaggttcaccatctccagagatgattacagagaacgacggcgtatctagacaaatagaacagacctacgaaaccgacggacgacggcgtagtacttacgtgtcgccagacacgtccgtacgttacttacgttattttcgagttcgtacccg

SEQ ID NO: 59827 - DNA, 859 bp, Homo sapiens
  misc_feature: GYAE6OF02ISYPG.26.57.F02.1.454.CMB.1.raw
tcagagactatactcacgaccggtgctcgatttagctcgatatagttgggtttgggggctgggagacggagctccagccttgggattcccagctgtctccgacctcggtgatcggcacgtgaatacaagagactcaccatcggagtttgggctgagctgggttttccttcgttgctactttaaaaggtgtccagtgtccaggtgcagctggtggagtccgggggaggcttggtccagccggggggtccctgaactcgtcatgtgcaggctctggattcacattcagtgactcggctatatacgtcgggtcccgccaggtctcggacccggggtaaagggcctggggagtcgggctttcgggaccgttagtttaacggaaaccccgtaaaaccgttggaacccgtaaacggtaccggaccggtaaacctaaagttttaacgtacggtacgttcgggcccggttaccggggttacgggacccggaaaggggtacccgtaacggggttttacccaaacccgtaactttacccgtaccccgtaacggtaacggtaacgttacggaacgtttaccgaaggtaaacggtaaacccgtaacccgggtacggttaaacgtaccgtttacggtaaccgtaaaagttaaccggtaaaccgtaaccggtaccccgtaaacggtaaaaaccccggtaacgggtaaacccgtaaacccggggtacccggttaacggttaccgtttaaccggttacgggtaaccgggtaccccggtaaacgggaacccgttaaccggttacccggttaaccggtttaacggtttaacccgttaacggtttttttacccgtacggtttaccggttaacccccgg

SEQ ID NO: 59828 - DNA, 536 bp, Homo sapiens
  misc_feature: GYAE6OF02GA95C.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccgggaaagggctggagtggcttggccgtattagaaccaaactgacaagtacgcgacaatttangctgcgtcggtgcaaggcaggtcacatctcagagatgattcagagaacgacggcgtatctagacaaatagaacagacctagaaaaccgaggacgacggccgtagtattactgtcgaccagacactccgtacgtacttacgtatttttctagtggtacccg

SEQ ID NO: 59829 - DNA, 579 bp, Homo sapiens
  misc_feature: GYAE6OF02HR9D6.26.57.F02.1.454.CMB.1.raw
  modified_base (373)..(373): a, c, t, g, unknown or other
  misc_feature (373)..(373): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccaggccggggggtcctgaaactctcatgtgcaggctctggattcacattcagtgactcggctatatacgtgggtccgccagtctggaccgggaaggctggagtggcttggccgtattagaacctaactgacaagacgcactaatttancgtctgcgtcggtgacaggcaggtcaccatctccagagatagatacagagaacgacggtacgtactcacgacaagtacgaacgacgaccgtaacgaaaccgaacggaccgacggtaccggttagtacgtttacgtacggtcgacctacgacctacgttccgtacgttacgttaccgttacttttttacgtacggttcgttacccgg

SEQ ID NO: 59830 - DNA, 601 bp, Homo sapiens
  misc_feature: GYAE6OF02GSLBD.26.57.F02.1.454.CMB.1.raw
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggtggtttcgtctaggcgtactttaaaagtgtccagtgtcaggtgcagctggtggagtccgggtgagggcttggtccagccgggggggtccctgaaactctcatgtgcaggcttctggattcacattcagttgactcggctatatactgggtccgccngtctgccgggaaaggctggagtggcttggccgtattaggaaccaacctgacaagtacgcacaatttnagctgcgttcggncgaagcaggtcacatcgtccagagatagattcgagagaacacggcgtatccgtgctaaagacgaacgacgtaccgttaacgaaaaacccggaggaaaccgtaccgggaccgttacggttaacttaccgtaggttaccgtaccgaaccgaacgtaccgttacccggttacgtttaacgtttaacggtaacttttttaccggagtttacccggg

SEQ ID NO: 59831 - DNA, 574 bp, Homo sapiens
  misc_feature: GYAE6OF02GP9DA.26.57.F02.1.454.CMB.1.raw
  modified_base (383)..(383): a, c, t, g, unknown or other
  misc_feature (383)..(383): n is a, c, g, or t
  modified_base (451)..(451): a, c, t, g, unknown or other
  misc_feature (451)..(451): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtcccgcgagtctggccgggaaagggctgggagtggcttgggccgtattacgaaccaaacctgaacaagtacgcgacaatttangctgcgtggtgcgaaggcgacggttcaccatcctccagacgatgtatcaagaagaacacggcgtatcngacaaatagaacagaccgtacgaaaccgacggaaccaacgggtaccgtacgttacgtacgtcggtcgacacgtactacgtccggtacgttacgttacgttatttttacgtagttcggtacccg

SEQ ID NO: 59832 - DNA, 570 bp, Homo sapiens
  misc_feature: GYAE6OF02INUDC.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccggggggtccctgaaactctcatgtgcaggctctggattcacattcagtgactcggctatatactgggtccgccgagtcgtggccgggaaagggcgtgggagtggcttgggccgtattacgaaccaaacctgacaagtacgcgacaatttatgctgcgtcggtgcgaaggcgagttcaccatctcagagatagattacgagaagaacgacggacgtactctagacaagtacgaacacgaccgtacgaaaccggacggacgacggccgtagtattacgtggtcgaccagactacgtcgttacgttacgttacgtactttttacgacgttacggtacccg

SEQ ID NO: 59833 - DNA, 542 bp, Homo sapiens
  misc_feature: GYAE6OF02HOFDA.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctctggattcacattcagtgactcggctatatactgggtccgccagtctgccgggaaaggctggagtggcttggccgtattagaaccaaacctgacaagtacgcgacaatttangctgcgtcggtgcaaggcaggttcaccatctccagagatgattcagagaacacggcgtatctgacaaagtagaacagacctacgaaaaccgaggaccacggccgtagtattactgtcgaccagacacgtccgtcgttacttacgttatttttacagttgtacccg

SEQ ID NO: 59834 - DNA, 612 bp, Homo sapiens
  misc_feature: GYAE6OF02FFW7Q.26.57.F02.1.454.CMB.1.raw
  modified_base (314)..(314): a, c, t, g, unknown or other
  misc_feature (314)..(314): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (419)..(419): a, c, t, g, unknown or other
  misc_feature (419)..(419): n is a, c, g, or t
tcagagactatactcacgaccggtgctcgatttagctcgatatagttggggtttggggactgggagaggagctccaagccttggggattcccagcctgtctccactcggtgatccggcactgaatacaagagactcaccatggagttgggctggagctgggttttcctgttgctattttaaaaggtgtccagtgtcaggtgcagctggtggagtccgggggagcttggtccaggccgggggggtccctggaaacctctcatgtgccaggctctggattcactattcagttgactcggctatatactgggtcccncagtctggaccggaaagggctaggagtggcttggcctattacgaaccaactgaacaagtacgcgaanaatttangctgcgtcggtgacgaggcaggttcaccgtntcctccagagatgatacgagacaacgacggctatctagaactaaatacgaaacgacgaccgtaacggaaaccgacggaaccgacggtaccgttagttacgttacgtggtacgaccgtaacgtaaccgtacgttacccggttaccgttaactttaaccggtttactttttaccgtaggttacccgttaacccgg

SEQ ID NO: 59835 - DNA, 560 bp, Homo sapiens
  misc_feature: GYAE6OF02IHXBU.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttggggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttgggtccaggcccgggggggtccctgaaactctcatgtgcaggctctggattcacattcagtgactcggctatatacgtgggtccgccagtctggccgggaaagggctgggagtggcttgggccgtattagaaccaaacctgacaagtacgcgaacatttangctgcgtggtgcaggcaggttcaccactctacagagatgattcagaagaacacggcgtatcagacaaatagaacacgcctagaaaccgaggaacgacggaccgtagtagttacgtagtcgaccgacgacacgtaccgtacgttagtttacgttatttttactaggttcgtacccg

SEQ ID NO: 59836 - DNA, 539 bp, Homo sapiens
  misc_feature: GYAE6OF02GAO8E.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccgggaaagggctggagtggcttggcctattagaaccaaacctgaacaagtacgcgaacaatttatgctgcgtcggtgcaaggcaggttcaccatctccagagatgattcaagagaacgacggacgtatctgacaatagaacagacctagaaaccgaggacgacggcgtagtattactgtcgccagacacgtccgtacgtacttacgttattttcgtagtcgtaccg

SEQ ID NO: 59837 - DNA, 567 bp, Homo sapiens
  misc_feature: GYAE6OF02H0M6N.26.57.F02.1.454.CMB.1.raw
  modified_base (382)..(382): a, c, t, g, unknown or other
  misc_feature (382)..(382): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggagtccgggggaggcttggtccaggccgggggggtccctggaaactctcatgtgcaggctctggattcacattcagtgactcggctatatacgtggtccgccagtcgtggccgggaaagggctggagtggcgttggccgtatacgaaccaacctgacaagtacgcgactaatttangctgcgtcggtgcgaaggcaggttcaccatctccgagagatgattcgaagaacgaacgacggacgtatctagacaaatacgaacagaccgtaacgaaaaccgaggaacgacggaccgtagttacgttacgtgtcgtaccagactacgtccgtacgtacttacgttatttttctagttcgtacccg

SEQ ID NO: 59838 - DNA, 807 bp, Homo sapiens
  misc_feature: GYAE6OF02IUME8.26.57.F02.1.454.CMB.1.raw
tcagagactatactcacgaccggtgctcgatttagctcgatatagttgggtttgggggtcgtggggaggaggagctccagccttgggattcccagctgtctccactcggtgatcggcactgaatacaagagactcaccatggagtttgggctgagctgggtttccttgttgctatttaaaggtgtccagtgtcaggtgcagctggtggagtcgggggaggcgttggtccaggccggggggtccctggaaacgtcgtcatgtgcgaggctcgtggattcgactattcgagtgacgtcggctagtatacgtcgggtcccgccgagtctcggacccgggaaagggcgtagggaggtagggtcgttgggacccggttaagttacggaaaccctaaaacccgtggaaccgaaacggttaccggccgtaacgtaaagttttacacggtacgtggtacccggttcggggttacgaccgtaaaggggtaccgtacgggttaccgtaacccgacgttaccgtacccgtaaggtaacgtaacgtagtaacgtttaccgaacggaacgaaaccggtaccgggtacgttaacgtaccgtacgaacgtaaagtacgaaaccgtaacgtacccgtaacgggtaaaacccggaacgggtaaacccggaaccgggtacccgggttaacgggttaaccgtttaccgttacgggtacgtacccggtaacggtaacccgttaaccggttacccggtttaccggtttaacgtttaacccggtttaacggtttttttaccgttacgggtttacccgggtttaccccgg

SEQ ID NO: 59839 - DNA, 526 bp, Homo sapiens
  misc_feature: GYAE6OF02HKXQM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggctggccgtattagaaccaactgacaagtacgcgacaatttatgctgcgtcggtgcgaaggcaggtcaccatctccagagatgatcagagaacacggcgtatctgacaaagtagaacagccgtagaaaccgaggacgacggaccgtagtatactgtgccagacgactccgtcgtattacgtattttacagtgtccg

SEQ ID NO: 59840 - DNA, 550 bp, Homo sapiens
  misc_feature: GYAE6OF02HVCZ9.26.57.F02.1.454.CMB.1.raw
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccnccagtctggccgggaaaggctggagtggcttggccgttatagaaccgaacctgacaagtacgcgactaatttangctgcgtggtgcgaaggcaggttcacatctccagagatgattcagagaacgacgcgtatctagcaatagaacagaccgtagaaaccgaggacacggccgtagtacttacgtcgtgaccacgaactacgtccgtacgttaacgttacgttactttttactaggttcgtacccg

SEQ ID NO: 59841 - DNA, 559 bp, Homo sapiens
  misc_feature: GYAE6OF02HDP6U.26.57.F02.1.454.CMB.1.raw
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagagactatactcacgaccggtgctcgatttagctcgatatagttgggtttggggctggggagaggagcctccagccttgggattcccagctgtctccacgtccggtgatcggcactgaagtacaagagactcaccatggagtttgggctgagctgggttttccttgttgctattttaaaaggtgtccagtgtcaggtgcagctggtggagtccgggggagcttggtccagccgggggttcctgaaactctcatgtgcaggctctggattcactattcagtgactcggctatatactgggtccgccagtctgccgggaaaggctggagtggcttggccgtatagaaccaaactgacaagtacncgacaattngctgcgtcgtgctaaggcagtcaccatctccagagatagattcagtagaacacggacgtatctagacaaatagaacagacctaagaaaccgacgaaccgacggccgtagtacgttacgtacggtcgaccgaacgactaacgtaccgtcgttaacgttacgttacgtttttacagttcggtacccg

SEQ ID NO: 59842 - DNA, 564 bp, Homo sapiens
  misc_feature: GYAE6OF02HIIY9.26.57.F02.1.454.CMB.1.raw
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttgggtccaggccgggggggtccctgaaactctcatgtgcaggctctggattcacattcagtgactcggctatatactgggtccgccagtctggaccgggaaaggctggagtggcttggccgttatacgaaccaaactgacagtacgcgacaatttngctgcgtggtgcaagcaggtcacatctccaganatgatcagagaacgacgacgtatctagactaaagtacgaacagacctaacgaaaccgaggaacacggacgtcgtacttacgttgtcggccaagtaaccacgttaccgtaccgtttacttacggtttacttttttacgtacggttcggttacccgg

SEQ ID NO: 59843 - DNA, 607 bp, Homo sapiens
  misc_feature: GYAE6OF02G18DF.26.57.F02.1.454.CMB.1.raw
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtcccgcagtctgccgggaaggctggagtggcttggcgtattagaaccaaactgaacaagtacgcgaactaatttangctgcgtcggtnacgaaggcaggttcaccatctaccagagatgattcagagaacacggcgtatctagacaaatacgaacacgacctaacggaaaacccggaagggaaccgaacgggtacccgttacggttacgttaacgtcggttacgacccgaaggtaaccgtacgttacccggttacgtttaacgtttaaccggttacgtttttttacctacgggttacggttaccccgg

SEQ ID NO: 59844 - DNA, 803 bp, Homo sapiens
  misc_feature: GYAE6OF02IQZVX.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctgggtggagtccgggggaggcttggtccaggccgggggggtccctgaaactctcatgtgcaggctctggattcacattcagtgactcggctatatacgtggtccgccagtctggaccgggaaggctggagtcggcttggctatacgaaccaaacgtgaacaagtacgacgaactaatttagcgtctacggccgtacgggtacacggaaagggtccgtaagggtttcccaaacccgtacttacccgttaacccgaacgggtaagtaacggttaacgtaacgttttaaccgaacggtaaaaccggaaaccggtaaccggggtaaccggtttaaccgttaccgttacggtaaacgtaaaacgttaccgggaaaaccgtaaacgggtacccgttaaaaccgggaaaaaaccccgggtaaacggggtaaaccccgtaaacccggggttaccccggtttaagtttaaccgttttaacggtttacgggtaaccggtacccggtaaacggtaaccccttaacggttaacccccggtttaacgttttaaaccggttttaaaccggttttaacgtttttttacccgggttaacggttcccgggttaacccccgg

SEQ ID NO: 59845 - DNA, 545 bp, Homo sapiens
  misc_feature: GYAE6OF02HVCP5.26.57.F02.1.454.CMB.1.raw
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccagccggggggtccctgaaactctcatgtgcaggctctggattcacattcagtgactcggctatatactggtccgccagtctgccgggaaggcnggagtggcttggccgtattagaaccaaactgacaagtacgcgacaatttangctagcgtcggtgcgaaggcaggtcaccatctccagagatgattcagagaacacggcgtatctagacaatagaacagaccgtacgaaaaccgacggaacgacggccgtagtacttactcggtgccgagtactactaccggtcgtacttacgtattttttacagttcggtacccg

SEQ ID NO: 59846 - DNA, 616 bp, Homo sapiens
  misc_feature: GYAE6OF02JY6VJ.26.57.F02.1.454.CMB.1.raw
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggagtttgggctgagctgggttttccttgttgctattttaaaggtgtccagtgtcaggtgcagctggtggagtccgggggagcttggtccagccggggggtccctgaaactctcatgtgcaggctctggattcacattcagtgactcggctatatactgggtccgcagtctgccgggaaaggctggagtggcttgggccgtattaggaaccaaaccgtgaacaagtacgacgacaatttacngtactgcggtcggtgacgagggctagggtcacgactctacgtacgagtagtgtattcaggaagaaccgacggtcgtaactctacggaccaaatacgaacgtagacccgtaaggaaacccgagggaaaccgaaccggtccgtaacggttacttacttacggtcgtaccgaacgtaaccgtacgtacccgttacggttaacgttaccggttaattttttccgtaacggttcggttaacccg

SEQ ID NO: 59847 - DNA, 603 bp, Homo sapiens
  misc_feature: GYAE6OF02GOITU.26.57.F02.1.454.CMB.1.raw
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaagggctgggagtggcttggccgtatacgaaccaaactgacaagtacncgacaatttangctgcgtcggtgcgaaggcaggttcacatctcagagatgatcagagaacacggcgtatctgacaatagaacgacgaccgtaacgaaaccgaacggaacgaaccgggtaccgtacggttacgttaccgtacggttccggacctaacggtaacctaaccgttacccggttaccggtttaacgttttaaccggttaactttttttaccgttacggttacggttaacccccgg

SEQ ID NO: 59848 - DNA, 532 bp, Homo sapiens
  misc_feature: GYAE6OF02F0S49.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctgggagtggcttggccgtattagaaccaaacctgacaagtacgcgacaatttatgctgcgtcgggtgcaaggcaggttcaccatctccagagatgattcagagaacacggcgtatctgcaaatagaacagcctagaaaccgagacacggccgtgtatactgtgaccagacagtccgtacgtacttacgtatttttcgtagttgtacccg

SEQ ID NO: 59849 - DNA, 568 bp, Homo sapiens
  misc_feature: GYAE6OF02FLCVR.26.57.F02.1.454.CMB.1.raw
  modified_base (396)..(396): a, c, t, g, unknown or other
  misc_feature (396)..(396): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggaggcgttggtccagccgggggggtccctgaaactctcatgtgcaggctctggattcacattcagtgactcggctatatacgtgggtccgccagtctggaccgggaaaggctggagtggcttggccgtattagaaccaaacctgaacaacgtacgcgaactaatttatgctgcgtcggtncgaaggcaggttcaccatctccagacgagtgtattcgagaagaacgacggcgtaactctagacaaatagaaccagacctacgaaaaccgaggaaccgacggccgtagttactacgtgtcgaccacgaactacgtcgtacgttagttaccgttatttttacgagttcggtacc

SEQ ID NO: 59850 - DNA, 527 bp, Homo sapiens
  misc_feature: GYAE6OF02FIGH9.26.57.F02.1.454.CMB.1.raw
  modified_base (436)..(436): a, c, t, g, unknown or other
  misc_feature (436)..(436): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccggaaagggctggagtggcttggccgtattagaaccaaactgacaagtacgcgacaatttatgctgcgtcggtgcaaggcaggttcaccatctccagagatgatcagagaacacggcgtatcngcaaatgaacagcctagaaaaccgaggacacggcgtcgtattactgtcgccagacatccgtcgtattacgttatttttcagttcggtaccg

SEQ ID NO: 59851 - DNA, 646 bp, Homo sapiens
  misc_feature: GYAE6OF02GW349.26.57.F02.1.454.CMB.1.raw
  modified_base (265)..(265): a, c, t, g, unknown or other
  misc_feature (265)..(265): n is a, c, g, or t
  modified_base (370)..(370): a, c, t, g, unknown or other
  misc_feature (370)..(370): n is a, c, g, or t
tcagagactatactcacgaccggtgctcgatttagctcgatatagttgggtttggggcctgggagaggagctccagccttgggattcccagctgtctccactcggtgatcggcactgaatacaagagactcaccatggagtttgggctgagctagggtttccttgttgctattttaaaaggtgtccagtgtcaggtgcagctggtggagtccgggggaggcttggtccagccgggggggtccctgaaactctcatgtgcaggctntggattcatattcagtgacttcggctatatacgtgggtccgccagtcgtggccgggaaagggctggagtcggcttggccgtattacgaaccaactgacaagtacncgactaattatgactgcgtacggtgaccgtaaggcgtacggtcctaccgacgtctaccgaagtagacgtacggtattacgaacggtaacggaaccgtaccgggtacgttactaccgtaggacaaacgttacggaaaccacggtaaccctaacggaaaacccgaacggtaacccggacgggtacccgtagggttaccttacgttcggtacgtaccgacgaacgtaccgtacgttacgttacttaaccgttactttttccgtaggttccggtaacccg

SEQ ID NO: 59852 - DNA, 560 bp, Homo sapiens
  misc_feature: GYAE6OF02GH4J7.26.57.F02.1.454.CMB.1.raw
  modified_base (372)..(372): a, c, t, g, unknown or other
  misc_feature (372)..(372): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggaggcttggtccagccggggggtccctgaaactctcatgtgcaggctctggattcacattcagtgactcggctatatactgggtccgcagtctggccgggaaggctggagtggcttggccgtatacgaaccaaacctgacaagtacgcgactaattangctgcgtcggtgcgaaggcgagtcaccatctccgagagatagatcagaagacgacggcgtatctgacaaatacgaacagacctaacgaaaccgaacggaccgacggccgtagtacttacgtagtcgaccgacgaactacgtaccgttacgttacttaccgttacgtttttcgtacggttcggtacccg

SEQ ID NO: 59853 - DNA, 544 bp, Homo sapiens
  misc_feature: GYAE6OF02GST7R.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtccgcagtctggccgggaaaggctgggagtggcttggccgtattagaaccaaccgtgacaagtacgcgactaatttangctgcgtcggtgcaaggcaggtcaccatctccagagatgattcagagaacgacggcgtatctagacaatagaacagcctacgaaaccgaggacgacggcgtgtacttacgtgtcgacacgacactccgtacgttacgttacgttactttttcgtacggttcgtacccg

SEQ ID NO: 59854 - DNA, 680 bp, Homo sapiens
  misc_feature: GYAE6OF02J01NB.26.57.F02.1.454.CMB.1.raw
  modified_base (326)..(326): a, c, t, g, unknown or other
  misc_feature (326)..(326): n is a, c, g, or t
  modified_base (427)..(427): a, c, t, g, unknown or other
  misc_feature (427)..(427): n is a, c, g, or t
tcagagactatactcacgaccggtgctcgatttagctcgatatagttgggtttgggggtcgtggggaggagggagctccagccttgggattcccagctgtctccactcggtgatcggcactgaatacaagagactcaccatggagtttgggctgagcgtgggttttccttgttgcttattttaaaaggtgtccagtgtcgaggtgcagctgggtggaggtccgggggaggtcgttgggtccgagggcccggggggggtccctaggtaaactctcgatggtcgcgaggcctcgtggtattcactatcagtgactcggctatatacgngggtcccgctagtcgtggccggggaaaggcgtgggagtggcttgggccttagttacgaaacctaaccgtgaaccgaaggtacgaccgtaactaatttacgngaccgtgaccggttcgggtagacgaaggtcgtacggttacacctactccgtaccgagacgtagtagacttacgaacggtaagaacgacggtacgtactacgtacgactaaacgtacggaactaacgaccgtaacgaaaccggtacggaaccggaccgggtaccgtacgttacgttacgtacggtaccgtacgacgtacgtacgtaccggttacgttacgttacgttaacgtttttcgtacggttaccgtaccg

SEQ ID NO: 59855 - DNA, 547 bp, Homo sapiens
  misc_feature: GYAE6OF02GJ9P1.26.57.F02.1.454.CMB.1.raw
  modified_base (380)..(380): a, c, t, g, unknown or other
  misc_feature (380)..(380): n is a, c, g, or t
  modified_base (456)..(456): a, c, t, g, unknown or other
  misc_feature (456)..(456): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgcagtctggaccgggaaaggctggagtggcttgggccgtattacgaaccaaactgaacaagtacgcgaactaatttangctgcgtcggtgacaaggcaggttcaccatcctcagacgatagattcgaagacgaacgacggcgtatctgacaaanagaacagacctagaaaccgagacgacggccgtagtattactgtcgacacgacacgtccgtacgtacttacgttattttcgagttcgtaccg

SEQ ID NO: 59856 - DNA, 525 bp, Homo sapiens
  misc_feature: GYAE6OF02GOLGA.26.57.F02.1.454.CMB.1.raw
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
tcagagactatactcacgaccggtgctcgatttagctcgatatagttgggtttggggctgggagaggagctccagccttgggattcccagctgtccccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaaaggctggagtggcttggcgtattagaaccaaactgacaagtacgacacaatttangctgcgtgngcaggcaggtcacatctcagagatgattcagagaacacggcgtatctgacaaagtgaacagacctacgaaaccgacggacacggaccgtgtattactgtgccagacactcgtcgtacttacgtattttcagttcgtcctagg

SEQ ID NO: 59857 - DNA, 643 bp, Homo sapiens
  misc_feature: GYAE6OF02GSIV8.26.57.F02.1.454.CMB.1.raw
  modified_base (184)..(184): a, c, t, g, unknown or other
  misc_feature (184)..(184): n is a, c, g, or t
tcagagactatactcacgaccggtgctcgatttagctcgatatagttgggtttggggctgggagaggagtctccagccttgggtaattcccagctgtctccactcggtgatcggcactgaatacaagagactcaccatggagtttgggctgagctggtttcctgtgctatttaaagtgtcagtntcaggtgcagctggtgaggtccgggggagcgttggtccgaggccggggggtcctgaactctcgatgtagcaggcctctggattcagtattcagttgaccgtcggactatataccgttcgggtccgaccgtagtcgtacgacccgggaaaggtccgtagggaagtggaccgttggaccgttaagtaacgaacctaaacgtgaacaagtacgacactaattcgagctgacgtcggtagaccgaaggtcgacggttacacctattcctcaagtactagtcgtagtactagaacgtaacgaacggtacgtacgtactcggaataaacgtacgtaaccggactaaccggtacgaaaaccggtacgaacgaccggtaccgtacgtagttacctcggtacgacctaacgacctacgtacccgttacgtaacctttacgttacttttaccggacgttcgtaaccccg

SEQ ID NO: 59858 - DNA, 535 bp, Homo sapiens
  misc_feature: GYAE6OF02G7E8W.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaaggctggagtggcttggccgtattacgaaccaaactgacaagtacgcgacaatttangctgcgtcggtgcgaaggcaggtacaccatctcagagatgattcagagaacacggcgtatctgacaaatagaacagacctagaaaccgaggacgacggcgtagtattacgtgtcgcagacacgtaccgtcgttacttacgttatttttcgtagtcgtccg

SEQ ID NO: 59859 - DNA, 567 bp, Homo sapiens
  misc_feature: GYAE6OF02JDYSS.26.57.F02.1.454.CMB.1.raw
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccgccagtctgccgggaaaggctgggatggcttggccgtattagaaccaaacctgacaagtacgcgacaatttangctgcgtcggtgcaaggcagttcacntctcaganatgatcagagaacacggcgtatctagacaaatagaacagacctaagaaaaccgaggaccgacgggtaccgtaggtactttacgtgtcgaccgaagaaccgacgtcccggttacgttaacgtttaaccgttacttttttacgacggttcggttaacccg

SEQ ID NO: 59860 - DNA, 534 bp, Homo sapiens
  misc_feature: GYAE6OF02GD0RJ.26.57.F02.1.454.CMB.1.raw
  modified_base (491)..(491): a, c, t, g, unknown or other
  misc_feature (491)..(491): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtaggctatttaaaaggtgtccagtgtcaggtgcagctggtggagtccgggggaggcttggtccagccgggggggtccctgaaactctcatgtgcaggctctggattcacattcagtgactcggctatatactgggttcgccagtctggccgggaaagggctggagtggcttggccgtattagaaccaaacctgacaagtacgcgacaagtttatgctgcgtggtgcaagggcaggttcacatctccagagatgatcagtagaacacggtcgtatctagacaaatgaacagaccgtacgaaaaccgaggacgacggccgtagtattacgngtgccagactagtccgtcgttattacgtattttcagtgtaccg

SEQ ID NO: 59861 - DNA, 579 bp, Homo sapiens
  misc_feature: GYAE6OF02FV5RC.26.57.F02.1.454.CMB.1.raw
  modified_base (380)..(380): a, c, t, g, unknown or other
  misc_feature (380)..(380): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggttttccgtgttagctattttaaaaggtgtccagtgtcaggtgcagctggtggagtccgggggaggcttggtccagccgggggggtccctgaaactctcatgtgcaggctctggattcacattcagtgactcggctatatactgggtcccgccagtctggccgggaaagggctggagtggcttgggcctattacgaaccaaacctgaacagtacgcgacaatttangactgcgtcggtgcaaggcaggttcaccactctccagagatgatcgagagaacgacggcgtatctacgacaaatagaacacgaccgtacgaaaccgacggacgacggaccggtgttacttacgtcgtacgacctaagaccgtacgttccgttacgttacgtttaacgttacttttttaccgtaggttccggttaccccg

SEQ ID NO: 59862 - DNA, 620 bp, Homo sapiens
  misc_feature: GYAE6OF02HIM7I.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggttagtccagtgtcaggtgcagctggtggagtccgggggaggcttggtccgaggccggggggtcccgtgaaactctcatgtgcaggctctggattcacattcagtgactcggactatatacgtgggtccgccagtcgtcggaccggggaagggcgtggagtggtcgttcggccgttattacgaaaccaacctagacgaagtacgacgaactaattatgctgcgtcggtgacgaagcgacgtacgacctactctaccacgagagtagtagtacgagagaacgacggacgtactacgtacgacgtaatacgaacgacgaccgaacgaaaccgaacggaacgacctaccggggggggtactacgttacgtacgtcgaccgacgaacgtaccgtaccgttacgttacgttacgtttacgttttacgttacgttacggttacccgg

SEQ ID NO: 59863 - DNA, 543 bp, Homo sapiens
  misc_feature: GYAE6OF02GYE15.26.57.F02.1.454.CMB.1.raw
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
  modified_base (440)..(440): a, c, t, g, unknown or other
  misc_feature (440)..(440): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtcccnccagtctggccgggaaaggctggagtggcttggccgtattacgaaccaacctgacaagtacgcgaacaatttangctgcgtcggtgcaaggcaggtcacatctcagagatgattcgagagaacgacggcgtatcngacaaatagaacagcctagaaaccgagacgacggcgtagtattactagtcgaccagacacgtaccgtacgttacgttacgttatttttacgaggtcgtacccg

SEQ ID NO: 59864 - DNA, 547 bp, Homo sapiens
  misc_feature: GYAE6OF02JZIW9.26.57.F02.1.454.CMB.1.raw
  modified_base (370)..(370): a, c, t, g, unknown or other
  misc_feature (370)..(370): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctctggattcacattcagtgactcggctatatactgggtccgccagtctgccgggaaggctggagtggcttggccgtatagaccaactgacaagtacgcgacattangctgcgtcggtgcaaggcaggttcaccatctccagagatgattacgagtacgaacgacggcgtatctgacaatagaacacgacctagaaaccgaggacgacgaccgtagtactacgtagtcgaccagacctagtaccgtacgttacgttacgttattttacgtaggttcgttacccg

SEQ ID NO: 59865 - DNA, 587 bp, Homo sapiens
  misc_feature: GYAE6OF02GOGOG.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctggccgggaaagggctgggagtggcttggccgtattacgaaccaacctgacaagtacgcgacaatttatgctgcgtcggtgcgaaggcaggttcaccatctcagagatgatcgagacgaacacggcgtatctagactaaatagaacgacgaccgtaacggaaaacccgaagggaaccgaacggaccgttagtacgttaccgtggtcggaccaacggacctacgttacccgttacgttaacgtttacgtttacttttttacgtaggttcggttacccg

SEQ ID NO: 59866 - DNA, 591 bp, Homo sapiens
  misc_feature: GYAE6OF02GWQR3.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaaagggctgggagtggcttggccgtattagaaccaactgacaagtacgcgaactaatttatgctgcgtcggtgacaaggcaggttaccaccatctccgagagatagattcaagacgaacgacggacgtactctgacaaagtacgaacacgaccgtacgaaaaccgacggaacgaccgggaccgtaggttacgttacgtggtacgacctaacggaccgtacttaccggttacgtacgtttaccgttacttttttaccgtaggttacgttaccccg

SEQ ID NO: 59867 - DNA, 559 bp, Homo sapiens
  misc_feature: GYAE6OF02HG8Y7.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttggtccagccgggggggtccctgaaactctcatgtgcaggctctggattcacattcagtgactcggctatatactgggtccgccagtctggccgggaaggctgggagtggcttggccgtattagaaccaacctgacaagtacgcgacaatttatgctgcgtcggtgcaaggcaggttcaccatctccagagatagattcgaagagaacgacggtcgtatcgtgacaaatagaacacgacctacgaaaaccgaggaacgacggaccgtagtacttacgtgtcgaccaggaccacgtaccgtcgttaacttaccgttactttttacgtagttcggtacccg

SEQ ID NO: 59868 - DNA, 527 bp, Homo sapiens
  misc_feature: GYAE6OF02GE1AY.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgtgagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaaggcaggttcaccatctccagagatgattcagagaacacggcgtatctgcaaatgaacagacctagaaaccgaggaacacggccgtgtattacgtgtcgccagacagtccgtcgtattacgtatttttcagttacgg

SEQ ID NO: 59869 - DNA, 546 bp, Homo sapiens
  misc_feature: GYAE6OF02I6T7M.26.57.F02.1.454.CMB.1.raw
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctggaaactctcatgtgcaggctctggattcacattcagtgactcggctatatactgggtccgcagtctggccgggaaaggctggagtggcttggccgtattacgaaccaaactgacaagtacgcgaactaatttangctgcgtcggtgcaaggcgaggttcacatctccagagatgattcagagaacgacggacgtatctgacaaatagaacagacctacgaaaccgacggacgacggccgtagtacttacgtgtcgaccagacacgtccgtcgtacgttacgtatttttcgagttcgtacccg

SEQ ID NO: 59870 - DNA, 638 bp, Homo sapiens
  misc_feature: GYAE6OF02G3O21.26.57.F02.1.454.CMB.1.raw
  modified_base (306)..(306): a, c, t, g, unknown or other
  misc_feature (306)..(306): n is a, c, g, or t
  modified_base (391)..(391): a, c, t, g, unknown or other
  misc_feature (391)..(391): n is a, c, g, or t
  modified_base (415)..(415): a, c, t, g, unknown or other
  misc_feature (415)..(415): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctattttaaaaggtgtccagtgtcaggtgcagctggtggagtcgggggaggcttggtccaggccggggggtccctgaaactctcatgtgcaggctctggattcacattcagtgactcggctatatacgtggggtcccncctagtccgtggcccggggaaagggctgggagtggcgttggccgtattacgaaaccaacctgaacaagtacgacgactaatttangctgcgtcgctgcaagcagtcacntctcgagagatgattacagaacgaacgacggacgtactacgtacgacaaagtagaaaccgacgaccgtaaacgaaaacccggtaacggtaaccggaaccgggtacccggttaggttaaccgtttaaccgtacggtaccggtaccgtaacggtaaccgtacgttacccggttacggtttaaccgtttaaccggtttacgttttttaccgaggttttaacccggg

SEQ ID NO: 59871 - DNA, 624 bp, Homo sapiens
  misc_feature: GYAE6OF02GZ25L.26.57.F02.1.454.CMB.1.raw
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctatttaaaaggtgtccagtgtcaggtgcagctgggtgggaggtccgggggaggcgttgggtccaggccgggggggtccctggaaactctcatgtgcaggctctggattcacattcagtgactcggctatatactgggtccnccagtctgccgggaagggctgggagtggcttggccgtattagaaccaacctgacaagtacgcgaactaatttangtactcgcgtcggtgacgaagggcgtagggttccaccgattcctacccgagtagatgtacttacagaagaacgacggacgtaatcgtagacaaagtagaaaccgtagaccgtaacgaaaaccgacggaaccgtaaccgggaccgtacggttaacttaccgtaggtcgacccgtaacgaaccgaacgttaccggttacgttaacgttaacgtttacttttttacgtacggttaccgttacccg

SEQ ID NO: 59872 - DNA, 916 bp, Homo sapiens
  misc_feature: GYAE6OF02F0FA5.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggagtcgttcggtccgacggggtcccgggggggtcccgtaacggtaaaccttccgtacgtagtggtgtccgacgggtccttcggtaggtacttccaactacgttccgtaaggtcgtaccgttccgggaccttaagtaacttaaccgggttcggggtccccgacccgtaggttccgtaccggggaacccgggggaaaaggggtccgttagggaacggttcgggtaccgtttcggggaccgttaagtttaaccggaaaaccccgtaaaaccgtacggaaacgtaaaccgggttaaccggaccgtaaaacgtttaaagttttaacgtcggtaccttacggggtcccggtttacggggtacggaaccggtaaacggtaccggttaaccgggttaaccgtaaacccgtacgttacccgtacccggtaaggtaacggtaacgtagtaaccgttacgaaggtaacggaaaccggtaccgggtaccgttaacgtccgttacgaacgtaaacgtacgaaaccgtaaccgtacccgttaaacgggaaaacccggaacgggaacccgtaaccgggtaccggttacggtttaacgtttaccgtacggttaaccggaccgtaaaccggtaaccgttaccggtttaccggtaccgtttaacggttttaccgtttaacgtttttttaccgaccgggtttacccggttaaccccggg

SEQ ID NO: 59873 - DNA, 607 bp, Homo sapiens
  misc_feature: GYAE6OF02FLYCY.26.57.F02.1.454.CMB.1.raw
  modified_base (387)..(387): a, c, t, g, unknown or other
  misc_feature (387)..(387): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggaggtccgggggaggcgttggtccgaggccgggggggtccctgaaactctcatgtgcaggctcgtggattcacattcagtgactcggctatatactcgggtccgccagtctggaccgggaaagggctgggagtggcttggccgtagttacgaaccaaactgacaagtacgcgactaattangctgcgtcggtgcgaaggcacggttacacctatctaccgagagatagatacagagaacgacggacgtacgtactagacaaagtacgaacacgtaccgtaacgaaaaccgaacgggaaccgaccgggtaccgtacgttacgttacgtcggtcggaccaggaacctacgtacccgttacgttactttaaccgttacttttttacgtacgttacggttacccg

SEQ ID NO: 59874 - DNA, 612 bp, Homo sapiens
  misc_feature: GYAE6OF02H8CS3.26.57.F02.1.454.CMB.1.raw
  modified_base (397)..(397): a, c, t, g, unknown or other
  misc_feature (397)..(397): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggaggtccgggggaggcttggtccagggcccgggggggtccctggaaactctcatgtgcaggctcgtggattcacattcagtgactcggctatatacgtgggtcccgccagtctggaccggggaaggcgtgggagtggtcgtggtccgtattacgaacctaaaccgtgaactaagtacgacgactaatttangctgcgtggtgacgaaggcgaggttcacctactctccgagagatgtattacgaagacgaacgacggcgttactcgtagaactaaagtacgaacacgaccgtaacgaaaccgaaggaccgaaccgggtccgtacgttacgttacgtaggtcgacccgacgacctacgtccgttcgttaacgtttaacgtttacgtttttacgtacgttcgtacccg

SEQ ID NO: 59875 - DNA, 555 bp, Homo sapiens
  misc_feature: GYAE6OF02JDCVO.26.57.F02.1.454.CMB.1.raw
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtcctgaaactctcatgtgcaggctctggattcacattcagtgactggctatatactgggtccgccagtctcggccggggaaggctggagtggcttggccgtattagaaccaactgacaagtacgcgactaatttangctgcgtcggtncaaggcaggtcacatctccagagatgatcgagaagaacacggacgtactcgtgacaagtacgaacagacctacgaaaccgacggaccgaacggccgtagtacttacgtgtcgcgtacgacctacgttccgtacgttactttacgttatttttcgtaggttcgtacccg

SEQ ID NO: 59876 - DNA, 641 bp, Homo sapiens
  misc_feature: GYAE6OF02IFKLD.26.57.F02.1.454.CMB.1.raw
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttttaaaaggtgtccagtgtcaggtgcagctggtggagtccgggggaggcttggtccaggccggggggtccctggaaactctcatgtgcaggctctggattcacattcagtgactcggctatatacgtgggtcccgcagtcgtggaccggggaaagggctggagtcgggcgttggaccgttattacgaaccaaaccgtgaacaagtacgcgaactaatttangctgcgtcggngacgaaggcgtaggttacaccacgtctaccgagaagagtagtagttacaagtaagaacgacggtacgtacgtactagacaaagtacgaacgacgaccgtaacgaaaaccgaacggaccgaaccgggtaccgttagttacgtttacgttaggtaccgaccgtaacgaccgtaacgttcccggttacgtttaacgtttaaccgtttacgttttttacgttacggttcggttaaccccgg

SEQ ID NO: 59877 - DNA, 577 bp, Homo sapiens
  misc_feature: GYAE6OF02JYKBZ.26.57.F02.1.454.CMB.1.raw
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctcgtggattcacattcagtgactcggctatatactggtccnccagtctgccgggaaggcgtggagtggctggcgtattagaaccaaacgtgacaagtacgcgaactaatttangactgcgtcggtgacgaaggcaggtcacctatctccagagatagacgttacacgagaaccgacggtacgtatcgtagacgaaattacgaacgtacgaccgtaacgaaaccgacggaaccgtaacggaccgtagtactacgtcgtacgaccaggaactacgtccgtacgttacgttacgttagttttcgtacgttcggtacccg

SEQ ID NO: 59878 - DNA, 565 bp, Homo sapiens
  misc_feature: GYAE6OF02F9H38.26.57.F02.1.454.CMB.1.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctgaaactctcatgtgcaggctctggattcgacattccagtgactcggctatatactgggtcccncagtctcggccgggaaggctggagtggcttggccgtattacgaaccaaacctgacaagtacgcgacaatttangctgcgtcggtgcaaggcaggttcacctatctcgagagatgacttcgagagaacgacggcgtatctagacaaatcgaacacgacctagaaaccgagaaccgacggaccgttagtacttacgtcggtcgaccacgactacgttaccgtacgttacgtttacgttatttttacgtacgttcggtacccg

SEQ ID NO: 59879 - DNA, 569 bp, Homo sapiens
  misc_feature: GYAE6OF02HOI1N.26.57.F02.1.454.CMB.1.raw
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtcccnccagtctgccgggaaaggctggagtggcttggccgtatagaaccaactgacaagtacgcgacaatttangctgcgtcggtgacaaggcaggttccacatctccagagatgattcgagagaacgacggtctatctgacaaatacgaacacgaccaacggaaaaccgacggaacgaccgggtccgtagtacgttactggtcgaccgaacgactacgtccgttacgttaacgtttacgttacttttttacgacggttcggtaacccg

SEQ ID NO: 59880 - DNA, 629 bp, Homo sapiens
  misc_feature: GYAE6OF02G806R.26.57.F02.1.454.CMB.1.raw
  modified_base (390)..(390): a, c, t, g, unknown or other
  misc_feature (390)..(390): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttggtccaggccgggggggtccctggaaactctcatgtgcaggctctggattcacattcagtgactcggctatatacgtgggtcccgccagtctggaccggggaaaggcctgggagtggcttggccgtattacgaacctaaactgaacaagtacgcgaactaatttagngtacgtgccgttcggtgacgaagggctacggttccaccgactctacgagacgatagattcgagaacgaacgacggacgtatctagacaaagtacgaaaccgacgaccgtaacgaaaaccgtacggaaccgacgggaccgttacgtacgtttacgtacggttacgaccgtaacgaacgttacgtaccggttacgttaacgttaccgtttacgttttttacgtacggttacggttaccccg

SEQ ID NO: 59881 - DNA, 573 bp, Homo sapiens
  misc_feature: GYAE6OF02IA8A3.26.57.F02.1.454.CMB.1.raw
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
tcagagactatactcacgaccggtgctcgatttagctcgatatagttgggtttcggggctgggagaggagctccagccttgggattcccagctgtctccactcggtgatcggcactgaatacaagagactcaccatgtagtttgggctgagctgggttttccttgttgctattttaaaaggtgtccagtgtcaggtgcagctgggtggagtccgggggaggcttggtccagccgggggggtccctgaaactctcatgtgcaggctctggattcacattcagtgactcggctatatactgggtccnccagtctggccgggaagggctggagtggcttggcgtatagaaccaaactgacaagtacgcgacaatttanagtctgacgtcggtgcaaggcaggttcaccatctaccagacgatagtattacagaacgaacacggacgtacgtcgtacgactaaagtagaacaacgaccgtaagaaaacccgaacggaacgaacggtaccgtagtacttacgtcgtcgaccagacagtccgtcgttacgttacgttatttttacgtacgttgtacccg

SEQ ID NO: 59882 - DNA, 565 bp, Homo sapiens
  misc_feature: GYAE6OF02F9RZZ.26.57.F02.1.454.CMB.1.raw
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (461)..(461): a, c, t, g, unknown or other
  misc_feature (461)..(461): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcttggtccgagggcccgggggggtccctagaaactctcatgtgcaggctcgtggattcacattcagtgactcggctatatacgtgggtcccgccagtctggccgggaaagggctggagtggcttgggccgttattacgaacctaaacctgaacaagtacgcgaactaatttatgctgcgtcggtgcgaaggcaggtcacatcncaganatagattcagagacacggctatctgacaagngaacagacctacgaaaaccgacgacgacggaccgtagtactacgtgtcgaccagactactaccgtacgttacgtttacgttatttttacgacgttcggtacccg

SEQ ID NO: 59883 - DNA, 659 bp, Homo sapiens
  misc_feature: GYAE6OF02FML82.26.57.F02.1.454.CMB.1.raw
  modified_base (154)..(154): a, c, t, g, unknown or other
  misc_feature (154)..(154): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (271)..(271): a, c, t, g, unknown or other
  misc_feature (271)..(271): n is a, c, g, or t
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggngttcgtgtaggctattaagtgtcagtntngtgcagctgtgagtcggggagctggtcagccggggggtcctgaactctcatgtgcaggctcgtggattcacattcagttgactccggntaatatactgggtcccgcctaaggtcctggacccggggaaagggcgtggaggtgggtnttcgggccggtattacgaaaccctaaaaccgngtaacgtaacgtcgacgtaactaaatttagtcgtcgtcggtcggttcggtagacggaaggcgtacgttcactatcctacgagtatatcgtactagagaacgaaccgacggtacgtacgtacgtacgtaacgtaacgtaacgtaacgaacgaaccggtaaaccggaaaaccggaaaccggaaccgtaaccgggtaccggttacgttagttacgttacggtaccggtacgtacgtaccgtaccgttaccgttacgttaccgtttaaccgttttacgttttacgttacggttacggtaccg

SEQ ID NO: 59884 - DNA, 584 bp, Homo sapiens
  misc_feature: GYAE6OF02G5FZY.26.57.F02.1.454.CMB.1.raw
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcactattcagtgactcggctatatacgtggtccgcagtctgccgggaaggctggagtggcgttggccgttattacgaaacgaacctgaactaagacgacgacaattatgctgcgtcggncaaggcaggtcacatcncagagatagtatcgagaagaacgacggacgtagtctagacaaatcgaaacgacgtaccgtaacgaaaaccgacggaaaccaacgggtccgtacgttacgttacgtaggtcgaccaacggtactacgttccggtacgttaacttacgtttaacgtttttacacggttacggttacccg

SEQ ID NO: 59885 - DNA, 531 bp, Homo sapiens
  misc_feature: GYAE6OF02FQN3X.26.57.F02.1.454.CMB.1.raw
  modified_base (377)..(377): a, c, t, g, unknown or other
  misc_feature (377)..(377): n is a, c, g, or t
  modified_base (483)..(483): a, c, t, g, unknown or other
  misc_feature (483)..(483): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaaggcaggttcaccatctccagagatgattcagagaacgacggcgtatctgacaaatagaacagacctagaaaccgagacacgcgtgtatacngtgccagacactccgtcgtacttacgtatttttcgtagtcggtacccg

SEQ ID NO: 59886 - DNA, 538 bp, Homo sapiens
  misc_feature: GYAE6OF02JIM6W.26.57.F02.1.454.CMB.1.raw
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
tcagagactatactcacgaccggtgctcgatttagctcgatatagttgggtttggggcgtgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggagtccgggggaggcttggtccagccgggggggtccctggaaactctcatgtgcaggctctggattcacattcagtgactcggctatatactgggtccgccgagtctgccgggaaagggctggagtggcttggccgtatagaaccaacctgacaagtacgcganaattatgctgcgtcgngcaggcaggttcacatctcagagatgacttcagacgaacacggctatcctgacaaagtgaacagacctacgaaaccgagacgacggtcgtagtattacgtgtcgccaagaccagtccgtagttacttacgttactttttcgagttcgttaccg

SEQ ID NO: 59887 - DNA, 717 bp, Homo sapiens
  misc_feature: GYAE6OF02I7FFH.26.57.F02.1.454.CMB.1.raw
  modified_base (267)..(267): a, c, t, g, unknown or other
  misc_feature (267)..(267): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtcggggagcttggtcaggccgggggtcctgaactctcatgtgcaggctctggattcganattcagtcgactcggctatactacgtggtcccgcgagtctacggtaccgggaaaggcgtaggagtcgggacgtttcgggaccgttaagttaacgaaacctaaaaccgtagaacctaaaggtaccgacgtaactaaactttatacggctagcggtacggtagacgaaggtcgtaacgggttacaacccgtacttaccgtacccgaaggtaacgtagttacgtaacgttacgtaaaggaacgaaaccgtaacgggtaccgttaacgtacgtacgtaaacctaaagtaacgtaaaccgaacgtaaccgtaaccgggaaaaaccgtaacggaaaccgtaaccgggaccgttaagtttactaccggttacgtaacgaccgtaacgtaaccgtaccgttaccgtacgtttaacgttaaccgtttacgttttttacgtacggtttcggttaaccccg

SEQ ID NO: 59888 - DNA, 575 bp, Homo sapiens
  misc_feature: GYAE6OF02HDUWP.26.57.F02.1.454.CMB.1.raw
  modified_base (393)..(393): a, c, t, g, unknown or other
  misc_feature (393)..(393): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccgggggaggcgttggtccaggcccgggggggtccctggaaactctcatgtgcaggctcgtggattcactattcagtgactcggctatatacgtgggtcccgccagtctggaccgggaaggctggagtggcttgggccgttattacgaaccaaacgtgaacaagtacgacgaactaatttangctgcgtcggtgacaaggcaggttcacctagtcctacagagatgattcgaagagaacgacggcgtactcgtagacaaagtacgaaacgagtaccgtaacgaaaacccgaggaaccgaacggtccgtagttacttacgtgtcgccagacactccgtctattacgttattttcgagtcgtaccg

SEQ ID NO: 59889 - DNA, 841 bp, Homo sapiens
  misc_feature: GYAE6OF02J3A13.26.57.F02.1.454.CMB.1.raw
tcagagactatactcacgaccggtgctcgatttagctcgatatagttgggttgggctgggagaggagctccagccttgggattcccagctgtctccactcggtgatcggcactgaatacagagactcacctagtggtagttgggctgagtctgggttttcctggttgacttagttttaaacggtcgtcctaggtgtcgtaggtcgacgtagcgtaggtcggtacggtccgggggacgtcgttcggtccggacgggtcccggggggtaccctaggtaaacctcgtacgtagttcggtcgacggtacggtcgttcgttacggactttaccggactagtttaccgacggttaccgtaccggtacggtaacttacgtacgtacggtcggtacccgtcgtaacgtcgtacgggacggtaacggtcgtacgggtagtccggtacgtacggtaccgttaaggtaaaccgtaaccgtaaccggacgtaacgtaacggtacccggtagtaacctaaagtttcgtacgtccggtacggtaccggtagggttaccgaacggtaccgtcgggtaacgtccaacccgttcgtaccgtacccggtaggtaacgttacgtagtaaaccgttccgaaacgttaccgggtaccgtaccggttgtaaccgtaccgtcggtaaacgaaccggttctaaaccggtacccgttacggaaaccggtaccgggtactccggtaacggttaccttacggtactttcccgggtatacccggtacgaacgttacccgttacggtttacccggttaacggtttacgttaccggttttacgtccggtaacccggttcggttaacccggg

SEQ ID NO: 59890 - DNA, 530 bp, Homo sapiens
  misc_feature: GYAE6OF02FP6XG.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtccgccagtctgccgggaaagggctggagtggcttgggccgtattagaaccaaactgacagtacgcgacaatttangctgcgtcggtgcaaggcaggttcaccatctcagagatgattcagagaacgacggcgtatctagacaaatagaacagacctacgaaaaccgagacgacggaccgtagtattactgtgccagacagtccgtcgtattacgtatttttcagtgtaccg

SEQ ID NO: 59891 - DNA, 711 bp, Homo sapiens
  misc_feature: GYAE6OF02JY3JK.26.57.F02.1.454.CMB.1.raw
  modified_base (371)..(371): a, c, t, g, unknown or other
  misc_feature (371)..(371): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaggtgtccagtgtcaggtgcagctggtggagtccggggagctggtccagccggggggtcctggaactctcatgtgcaggtctcgtggattcactatcagtgactggctatatactggtccgccagtctggccggaaggctggagtggcttggcctagttagaacctaaccgtgacaaggtacacgaactaatttangcttcgacgttacggtcgacgaacggcgtacgggttacaaccgtaacttccgtacccgaacgtacgtaacgttagggtaactttacgaaggtaacgaaacggtaaccggtaccgggtacttacgtacgtacggtaaacttaggtaaaccgtaaggacccgttaacgggtaaaaacccggtaacgggtaaacccggaacccggggtaacccgttacggttaacgtttaccggttaaggttcccggaccgtacggtaacccgtacgttaacccggtttaccggtttaacgtttaaaccgggtttacctttttttacggttaccggttaccgggtttccccgg

SEQ ID NO: 59892 - DNA, 539 bp, Homo sapiens
  misc_feature: GYAE6OF02HB62N.26.57.F02.1.454.CMB.1.raw
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatacgtgggtcccnccagtctggccggggaaagggctggagtggcgttggccgtattagaaccaacctgacaagtacgacgacaatttangctgcgtcggtgacagcaggtcaccatctcagagatgattcgagacgaacgacggcgtatctgacaagagaacagctagaaccgagacacggcgtagtatactgtcgaccagactacgtccgtacgtacttacgttacttttacgtacgtcgtacccg

SEQ ID NO: 59893 - DNA, 554 bp, Homo sapiens
  misc_feature: GYAE6OF02F32LB.26.57.F02.1.454.CMB.1.raw
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccagccggggggtcctgaactctcatgtgcaggctctggattcacattcagtgactcggctatatactgggtccgccagtctggccgggaaggctgggagtggcttggccgtattagaacccaaactgaacaagtacgcgaactaatttagngactgcgtcggtgcgaaggcaggttcaccatcctccagnatgattcagagaacacggcgtatctgacaatagaacacgaccgtaacgaaaccgaggacgaccggccgtagtattacgtgtcgaccgagtaccacgtaccgtacgttacttaccgttatttttacgtagttcgtacccg

SEQ ID NO: 59894 - DNA, 657 bp, Homo sapiens
  misc_feature: GYAE6OF02FY86A.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgcagtctgccgggaaggctggagtggcttggccgtattagaaccaaacctgacaagtacgcgacaatttangctgcgtcggtgcaggcaggtcaccatctcagagatgatcagaagaacgacggacgtatctagactaaagtcgaaacacgaccgtaacggtaaaacccggacgggtaaaccgaacccggggtacccggttaacggttaacgtttaaccgttacgggttaccggaccccgtaacgggtaaacccgtaaccggtttaccccggtttaccgggttttaaacgttttaacccgggttttaactttttttttaccggtaaccgggttttaccgggtttaaccccccgg

SEQ ID NO: 59895 - DNA, 642 bp, Homo sapiens
  misc_feature: GYAE6OF02I8HLK.26.57.F02.1.454.CMB.1.raw
  modified_base (381)..(381): a, c, t, g, unknown or other
  misc_feature (381)..(381): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactcgtcatgtgcaggctcgtggattcacattcagtcgactcggctatatacgtgggtccgcagtctggccgggaaggcgtaggagtggcttggccgtatacgaaccaactgacaagtacgcgaactaattangctggcgtacggtgacaaggcgtaggttacacctactccgtaccgtagacgacgtagacttacgacgaacgaacgacggtacgtacgtcaggtaacaaagtacgaacgacgtaccgtaacggaaaaccggacggaaccgaaccgggtacgttacgttacgttaacggtcggttaacggaccgtaacgtaaccgtaacgttacccggttacgtttaacgtttaaccgtttaacgtttttacgtacggttccggttaacccgg

SEQ ID NO: 59896 - DNA, 578 bp, Homo sapiens
  misc_feature: GYAE6OF02IJK8H.26.57.F02.1.454.CMB.1.raw
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtcaggccggggggtcctgaaactctcatgtgcaggctctggattcacattcagtgactcggctatatacgtgggtcccncagtctggccgggaagggctggagtggcttggccgtatagaaccaaactgacaagtacgacgacaatttangctgcgtcggtnacgaaggcgtaggttcaccactctcagagatgtattcgagaacgaacgacggacgtatctagactaaatagaacgacgacctaacggaaaaccggaggaaccgaaccgggccgtacgtacttactacggtcgaccgagaactacgttccgtacgttacgtttacgttagttttttacgtagttcggtacccg

SEQ ID NO: 59897 - DNA, 540 bp, Homo sapiens
  misc_feature: GYAE6OF02ICPTW.26.57.F02.1.454.CMB.1.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (405)..(405): a, c, t, g, unknown or other
  misc_feature (405)..(405): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaggtgtccagtgtcaggtgcagctggtggagtccgggggagcttggtccaggccggggggtcctgaaactctcatgtgcaggctctggattcacattcagtgacttcggctatatactgggtccnccagtctgaccgggaaggctggagtggcttggccgtatagaaccaactgacagtcgacgacaatttacngactgcgttacggtgacaaggcaggttcaccactcncctagagatgattcagagaacacggcgtatctgacaaatagaacagacctacgaaaccgacggacgacggaccgtgtacttacgtgtcgaccagactactccgtctacgttacgttatttttcacgttgtacccg

SEQ ID NO: 59898 - DNA, 642 bp, Homo sapiens
  misc_feature: GYAE6OF02HZABX.26.57.F02.1.454.CMB.1.raw
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggagtttgggctgagctgggttttcctgttgctattttaaaaggtgtccagtgtcaggtgcagctggtggagtccgggggaggcttggtccaggccgggggggtccctgaaactctcatgtgcaggctctggattcacattcagtgactcggctatatacgtgggtcccnccagtctggccgggaaaggctggagtggcttggccgtattacgaaccaaacgtgacaagtacgacgacaatttangactggcgtcggtgacgaaggcaggttcacctatcctccagacgatagattacgaagaacgaacgacggacgttaagtctacgactaaagtacgaaacgaacgccgtaaacgaaaaccggtaacgggaacccgaaccgggtaccgttacgttacgtttaccgtacggttacgacccgaacgtaacctaaccgttacccggttacgtttaacgttaccggttttaacgtttttttaccgtacgggtttaccggttaaccccgg

SEQ ID NO: 59899 - DNA, 560 bp, Homo sapiens
  misc_feature: GYAE6OF02ITNSW.26.57.F02.1.454.CMB.1.raw
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccggggggtccctggaaactcgtcagtgtgcgaggctcgtggattccacattcagtgactcggctatatactgggtcccgccgagtctggaccgggaagggctgggagtggcttggccgtattagaaccaaccgtgacaagtacgcgaactaatttangctgcgtggtncaaggcaggtcacgatcncagagatgattacagagaacgacggacgtactctagacaaagtacgaacacgacctacgaaaaccgacgacgaccgacgtacgtatacgtacgtgaccgagacactccgtacgtacttacgttacttttcgtagtcgtaccg

SEQ ID NO: 59900 - DNA, 618 bp, Homo sapiens
  misc_feature: GYAE6OF02HGCOD.26.57.F02.1.454.CMB.1.raw
  modified_base (297)..(297): a, c, t, g, unknown or other
  misc_feature (297)..(297): n is a, c, g, or t
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggtgttcgtgtaggctattaaagtgtcagtgtcagtgcagctggtggagtccgggggagcttggtccagccggggggtccctgaacgtctcatgtgcaggctctggattcgacattcagttgactggactatactacgtgggtccnccgagtctcggaccggggaaaggcgttggagtggcttggacctattacgaaccaactgactaagtcgacgtactaattangtctagtcgtcggtagcaaggtctacggttcacctagtctaccagacgagtacgtattcgaagtacgaaccgacggtccgtaagtccgtaggacctaaagtaacgacgacgaccgttaacgaaaaccggacggaaccgtaacgggaccttaggtacgttacgtacggtcgtaccgacgtaacgtacgttaccgttacggttacgtttacgtttaactttttcgtaacgttcggttacccgg

SEQ ID NO: 59901 - DNA, 552 bp, Homo sapiens
  misc_feature: GYAE6OF02IZ28Q.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctggccgggaaagggctgggagtggcttggccgtattagaaccaaactgaacaagtacgcgacaatttatgctgcgtcggtgcgaaggcagggttacaccgatctccagacgatgattcagaagaacacggtacgtatactgacaaagtagaacgacgccgtaagaaaccgaggacacggacgtagtagttactgtcgccagacacgtcgtacgtacttacgttatttttacgacgtgttaccg

SEQ ID NO: 59902 - DNA, 581 bp, Homo sapiens
  misc_feature: GYAE6OF02GMVWA.26.57.F02.1.454.CMB.1.raw
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttgggtccaggccgggggggtccctgaaactctcatgtgcaggctctggattcacattcagtgactcggctatatactgggtccgccagtctggccgggaaagggctgggagtggcttggccgtattacgaacctaaactgacaagtacgcgaactaatttangctgcgtcggtgcaaggcaggttccactatcncagagatgatcagacgaacacggcgtatcgtagacaaagtacgaacacgacctaacggaaaaccgaggaaccgacggaccgtagttacttacgtcgtcgacccagaacctacgtacccgttacgttactttaaccgtttactttttcgtacggttacggtacccg

SEQ ID NO: 59903 - DNA, 534 bp, Homo sapiens
  misc_feature: GYAE6OF02FYGGL.26.57.F02.1.454.CMB.1.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccncagtctggccgggaagggctgggagtggcttgggccgtattagaaccaaacctgaacaagtacgcgacaatttangctgcgtcggtgcgaaggcaggttcaccatctacagagatgatcagagaacacggcgtatctgacaatagaacacgactacgaaaccgacgacgacggccgtgtattacgtgtcgacacgacacgtcgtacgtattacgtatttttcgagtgtaccg

SEQ ID NO: 59904 - DNA, 647 bp, Homo sapiens
  misc_feature: GYAE6OF02I5SUB.26.57.F02.1.454.CMB.1.raw
  modified_base (403)..(403): a, c, t, g, unknown or other
  misc_feature (403)..(403): n is a, c, g, or t
  modified_base (619)..(619): a, c, t, g, unknown or other
  misc_feature (619)..(619): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccggggggaggcttgggtccgagggcccgggggggtccctggaaactctcagtgtgcaggctctggattcacattcagtgactcggctatatacgtgggtcccgccagtcgtggaccggggaaagggcgtgggaggtggcgttggaccgttattacgaaccaaacctgaacgaagtacgacgactaatttangtctgtcgtcggtgcgaagggctaggttacaccgtatcctacagagtatgattacgaggacgaacgacgggtacgtatcgtagacaaagtacgaaacgacgaccgtaaacgggaaaaccggtaacggaccgaaccgggtaccgttacggtacgtttacggtcgtacggacctaacggtacctacgttacccggttacgttactttaaccggttttnttttacggtacggttccggttaacccgg

SEQ ID NO: 59905 - DNA, 532 bp, Homo sapiens
  misc_feature: GYAE6OF02FGMCY.26.57.F02.1.454.CMB.1.raw
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatagagtttgggctgagctgggtttttccttgttgctatttttaaaaggtgtccagtgtcaggtgcagctgatggagtccgggggaggcttggtccagccgggggggtccctgaaactctcatgtgcaggctctggattcacattcagtgactcggctatatactgggtccnccagtctgccgggaaaggctggagtggcttggccgtatagaaccaacctgacagtacgcgacaatttangctgcgtcggtgcgaaggcaggtcaccatctccagagatgattcagagaacgacggcgtatctgacaaatgaacagacctagaaaccgaggacgacggccgtgtactacgtgtcgaccgagacagtccgtcgttacttacgtagtttttcagttacgg

SEQ ID NO: 59906 - DNA, 596 bp, Homo sapiens
  misc_feature: GYAE6OF02FHDL7.26.57.F02.1.454.CMB.1.raw
  modified_base (279)..(279): a, c, t, g, unknown or other
  misc_feature (279)..(279): n is a, c, g, or t
  modified_base (389)..(389): a, c, t, g, unknown or other
  misc_feature (389)..(389): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggtcttggtccgaggccgggggggtccctggaaactctcatgtgcaggctcgtggattcanattcagttgactcggctatatactgggtccgccagtcgtggaccgggaaagggctgggagtggcttgggccgtattagaacccaaactgaacaagtacgacgacaatttngctgtcgtcggtgacgaaggcagttcaccatctccagagatagatagagaacgaacgacggacgtatcgtagactaagtagaacgacgaccgtaacgaaaccgagaaccgaccggtcgtacgttacttacgtgtaccgaccgacgacgtaccgttaccgttaccgttacgtttaaccgtttagtttttacgtaggttccgttacccg

SEQ ID NO: 59907 - DNA, 533 bp, Homo sapiens
  misc_feature: GYAE6OF02IDP3H.26.57.F02.1.454.CMB.1.raw
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatacgtggtcccgccagtctggccgggaagggctggagtggcttggccgtattagaaccaaactgacaagtacncgacaatttangtctgcgtcggtgcaaggcaggttcaccatctccagagatagattcgagagaacacggcgtatctagacgaaatagaacacgctagaaaccgaggacacggcgtgtatactagtcgccagacactcgtcgttattacgtatttttctagttgtaccg

SEQ ID NO: 59908 - DNA, 884 bp, Homo sapiens
  misc_feature: GYAE6OF02I8UFL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgttgctatttaaaggtgtccagtgtcaggtgcagctgggtggaggtccgggggaggcgttgggtccgaggccgggggggtccctggaaactctcatgtgcaggctcgtggattcactattcagtgactcggctatatacgtcgggtcccgccagtcgtacggaccgggaaagggccgtagggagtgggtcgttacgggtcccgttaagttaacgaaaccccgtaaaccgtacggaaaccgtaaacgggtaccgtaacggtaacctaaattttaacgtggtaccgttacgggtacccgggttacgggtacggaccgtaaacggggccgtaaaccgggtttacccgtaacccgtaacgttccgttacccgtaaccggtaaggtaacggttacggtaacgtttaccgtaacggtaaaccggtaaaccggtaaccggggtaaccggttaacgttaccgtacgggtaaacgtaaaacggttaacggtaaaaccgtaacccggtaaccgttaaaccgggaaaacccgggtaaaccgggtaacccggtaaaccccggggttacccggttaaccgggttaacgttttaacccggttaacgggttaccgggtaacccggtaaacggtaaacccgttaccgtttaacccccgggttaacggttttaaccggtttaaacccgttttaaccggttttttttaaccggttaccgggtttaccggtttaacccccggg

SEQ ID NO: 59909 - DNA, 559 bp, Homo sapiens
  misc_feature: GYAE6OF02HIJ5K.26.57.F02.1.454.CMB.1.raw
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtcccgcagtctggaccgggaaaggctgggagtggcttgggccgtattacgaaccaaacctgacaagtacgcgacaatttangctgcgtcggncgaaggcaggttcaccatctccagagatgattcagagaacacggcgtatctagacaaatacgaacacgaccgtacgaaaaccggaggaacgacggaccgtagtacgttacgtgtcgaccacgacacgtccgttacgtacttacgttatttttacgtacgttgtacccg

SEQ ID NO: 59910 - DNA, 885 bp, Homo sapiens
  misc_feature: GYAE6OF02JA52S.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtcagtgtcaggtgcagctggtggaggtccgggggaggcttggtccaggccggggggtccctgaaactctcatgtgcaggctctggattcacattcagtgactcggctatatacgtcgggtccgccgagtcgtcggcccggggaaaaggggccgttagggagttgggcgtttcgggacccggttaagttaacggaaaacccctaaaaacccgttcggaaaacccgtaaaacggtttaaccgggacccgtaaaaccgttaaaagtttttaacgtaccggtaccgttcggggacccggtttccgggggtttaacggccggaaaaacggggtccggtaacggggtttaccctaaaccctaaccgttaccgttaccccgaaaggaacggtaagtagggttaactttacccgaaagggtaaaccggaaaccggacccggggtaaccgtttacggttaaccgtttacgggaaccgtaaaaaattaccgggaaaaccaaccgggtaacccgttaaaccgggaaaaaacccgggaaacggggaacccggtaaacccggggtaccgggtttaaccggttacgttttaaccgttacggttaaccgggtaaccccgaaggtaaacccgtacccgttaccgggttttaccgttaaacgttttacccggttttaacgtttttttaccgggttaacgggtttcccggtttaaccccggg

SEQ ID NO: 59911 - DNA, 776 bp, Homo sapiens
  misc_feature: GYAE6OF02IWZM0.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggagcgttggtccgaggccggggggtcctaggaaactctcgatgtgcgaggctcgtggattcacattcagtgactcggctatatacgtgggtccgccgagtcgtaggaccggggaaagggcctagggtaggtcggcgttgggaccggttaattacggaaacctaaacctggaaccaaaggttaccgacgtaactaagtttaacgtggtaccgtggtccggttacgggtcgtacgaacgggtccgtaacgggtttccgaaccgtacgttacccgtaccgtaacggtaacgtacgttacggtaacgttaccgaaggtaaacgaaaccgtacgggtaccgttaacgtacgtacggtaaccgtaaaagtacggtaaaccgtacgtaacccggttaacggaaaaacccgggtaacggtaaaccggtaaacccgggtaccgggttacggttaccgttaaccggttacggtaccgggtaccgtaaccggtaaccgtaaccgttaccgggttaccgttaaccgtttaaccggtttacgttttttacggtaaccggtttcggttaaccccgg

SEQ ID NO: 59912 - DNA, 583 bp, Homo sapiens
  misc_feature: GYAE6OF02G1CRD.26.57.F02.1.454.CMB.1.raw
  modified_base (379)..(379): a, c, t, g, unknown or other
  misc_feature (379)..(379): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgcagtctggtcgggaaagggctggagtggcgttggccgtattacgaaccaaactgacaagtacgcgaacaatttangctgcgtggtgcaaggcaggttcacactcctcagagatgattcgagaagaacgacggcgtatctagacaaagtacgaacagaccgtaacggaaaccgacggaaccgaaccgggaccgtacgttacgttacgttcggtcgaccgaacgaccacgttccgtacgttacgtttaccgtttacgtttttacgtacgttcggttacccg

SEQ ID NO: 59913 - DNA, 725 bp, Homo sapiens
  misc_feature: GYAE6OF02J25ZB.26.57.F02.1.454.CMB.1.raw
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctgggtggaggtccgggggagcttggtccgaggccggggggtcctgaaactctcatgtgcgaggtccttgtggacttcactactttcgagtcgactcggtacttaatacgtacgtcgggttcccgacgtacgttcgtggaccggggaaggtcgtggacgtggcgttacggccgttaataacgaaaccgtaacagaacgtaacggtaccgacgtacttaacgtttangtactggccgttacgngacgaacggtctacggtaccacgtactcgtaccgagacgtacgtagtactacgaaggaacgtaacgtaccggtacgtacgtacgtacgtaaactaaacggtacgaaaccggtacgaaccgttaaacggaaaaacccgggacgtaaaccggtaccggtaccgttaacgttacgttaccgtaccgtacggtacccgtaagtaacccgttaacggttacccgtttaacgtttacgtttaaccggttttaccgtttttacggtaccggttacccggtttaacccgg

SEQ ID NO: 59914 - DNA, 602 bp, Homo sapiens
  misc_feature: GYAE6OF02G4NPG.26.57.F02.1.454.CMB.1.raw
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctgggtggaggtccgggggaggcttggtccgaggcccgggggggtccctggaaactctcatgtgcaggctctggattcacattcagtgactcggctatatacgtcgggtccgccagtcgtggaccggggaaagggcgtgggagtggcgttgggccgttattaacgaaccaaccgtgaacaagtacgacgaactaatttngtctgcgtcggngacgaaggcgaggtcacatctacgagagatgtatcgaagtagaacgacggacgtagtctagacaaagtacgaacagtaccgtaacgaaaccgacgggaaccgaccgggtaccgtagttacgttacgtcggtcggaccaacgactacgtaccgttacgttacttacgttactttttacgtacggttccgtaccg

SEQ ID NO: 59915 - DNA, 643 bp, Homo sapiens
  misc_feature: GYAE6OF02HUNYP.26.57.F02.1.454.CMB.1.raw
  modified_base (320)..(320): a, c, t, g, unknown or other
  misc_feature (320)..(320): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggagtccggggggaggcgttggtccaggccgggggggtccctgaaacctctcatgtgcaggctcgtggtattcactattcagtgacgtcggactatatacgtgggtcccgccaggtcncgggaccggggaaagggcgtgggagtggtcgttggccgtattacgaaaccaaccgtgacgaagtacgacgaactaattagcgctgcgtggtgacgaaggcgtaggtccaccgtactcctaccgagagtagtgtatacgaagaacgaacgacggtacgtacgtctagactaaagtacgaacacgtaccgtaacggaaacccggacggaaccgaaccggtccgtagttacgttacggtacggtcgaaccgaagtaaccgtaccgttaccggttaccgtttacgtttaacggtttactttttacggtaccggttacggtaaccccg

SEQ ID NO: 59916 - DNA, 531 bp, Homo sapiens
  misc_feature: GYAE6OF02II8RP.26.57.F02.1.454.CMB.1.raw
  modified_base (375)..(375): a, c, t, g, unknown or other
  misc_feature (375)..(375): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacatttangctgcgtcggtgcaaggcaggttcaccatctccagagatgattcagagaacgacggacgtatctagcaaatagaacagcctagaaaccgaaggacgacgcgtgtattactgtgccagacactccgtcgtacttacgtattttactcgttgtacccg

SEQ ID NO: 59917 - DNA, 825 bp, Homo sapiens
  misc_feature: GYAE6OF02IMVMB.26.57.F02.1.454.CMB.1.raw
  modified_base (274)..(274): a, c, t, g, unknown or other
  misc_feature (274)..(274): n is a, c, g, or t
tcagagactatactcacgaccggtgctcgatttagctcgatatagttgggtttggggctgggagaggagctccagccttgggattcccagctgtctcccactcggtgatcggcactgaatacaagagactcaccatggagtttgggctgagctgggttttccttgttgcttattttaaaaggtgtccagtgtcaggtgcagctggtggaggtccgggggaggcttgggccagggccgggggggtccctagaaacctctacgatgtgcaggcctntggattcactattcagtgactcggctatatacgtcgggtccgcctaggtcctggacccggggaaagggccgtcggggagtcgggccgtttgggcccgttaagtttaacggaaacccctaaaaccgtcggaaacccgaaaggtttaacccggaccgtaaacgtaaacgtttttaacgtacggtaccttagggtcccggttacggggtacgccggtaaaagggtcttaacgggttacccgaacccacgttacccctacccggaaggtaaacggtaacgttaaccggtaacgttttaccgaagggtaaacgtaaaacccgggacggggttacccgttaaactttccggtaaacgaacggaaaaacctttacgggaaaacccaaacggttaaacccggtaaacgggaaaacccggtaaccggaaaccggtaacccgggtaccgtttaaggtacctttaccgggtacgtaaccgaccggtaacgtaacctacccggtttcccttaaggttaaccttttaccggttttactttaacgtccgggttacccgtaaccgg

SEQ ID NO: 59918 - DNA, 588 bp, Homo sapiens
  misc_feature: GYAE6OF02GV28U.26.57.F02.1.454.CMB.1.raw
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttggggtttggggctgggagaggagcctccagccttgggattcccaggctgtctccacctcggtgatcggcactgaatacaagagactcaccatggagtttgggctgagctgggtttcctgttgctattttaaaaggtgtccagtgtcaggtgcagctggtggagtccgggggaggcttggtccaggccgggggggtccctgaaactctcatgtgcaggctctggattcacattcagtgactcggctatatactgggtccncagtctggccgggaaggctggagtggcttggccgtatacgaaccaacctgacaagtacgcgaactaatttangctgcgtcggtgacgaaggcacggtcaccatcctaccgagagatgtatcgaagaagaaccgacggtcgtactctagacaaagtacgaacacgaccgtaacgaaaccgacggaaccgaccggtccgtagtacgttacgtacgtcgaccgagaaccgtacgttaccgttacgttacgtttacgttactttttacgtaggttacggttacccg

SEQ ID NO: 59919 - DNA, 560 bp, Homo sapiens
  misc_feature: GYAE6OF02GHPLC.26.57.F02.1.454.CMB.1.raw
  modified_base (388)..(388): a, c, t, g, unknown or other
  misc_feature (388)..(388): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccgggggggtccctgaaactctcatgtgcaggctctggattcacattcagtgactcggctatatactgggtccgcagtctggccgggaaagggctgggagtggcttgggccgttagttaacgaaccaaaccgtgaactaagtacgcgactaatttangctgcgtggtgcaaggcaggttcacctatctacagagatgtatacagacgaacgacggcgtatctagacaaatagaacagacctaagaaaccgagaccgacggcgtatattacgtgtcgaccgagacacgttccgtacgttacttacgttactttttcgaggttcgtacccg

SEQ ID NO: 59920 - DNA, 609 bp, Homo sapiens
  misc_feature: GYAE6OF02IIU14.26.57.F02.1.454.CMB.1.raw
  modified_base (306)..(306): a, c, t, g, unknown or other
  misc_feature (306)..(306): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgtgctatttaaaaggtgtccagtgtcaggtgcagctggtggagtccgggggaggcttggtccaggccggggggtccctgaaactctcatgtgcaggctctggattcgactattcagtgacgtcggctattactacgtcgggtcccnccagttctggccgggaaaggctgggagtggcgttggccgttataagaacctaacgtgactaagtcgcaactaatttancgactgtcgtacgggngacgaggctacggtcaacctatctacgagtagatcggaattcgagtaacgtaacgacgtcgtaagtcgtagaccaaagttagaactacggacctaagaaaccgacggacgaccggtcgttagtacgttaacgtcggtacaccgtaagtaccgtacgttaccggttcgttaacgttaaccgttacgttttccgtaggttaccgtacccgg

SEQ ID NO: 59921 - DNA, 684 bp, Homo sapiens
  misc_feature: GYAE6OF02HT3QQ.26.57.F02.1.454.CMB.1.raw
  modified_base (319)..(319): a, c, t, g, unknown or other
  misc_feature (319)..(319): n is a, c, g, or t
  modified_base (413)..(413): a, c, t, g, unknown or other
  misc_feature (413)..(413): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagcgtgggtggaggtccgggggaggtcttgggtccagggcccggggggtccctggaaactctcatgtgcgaggctcgtggacttcgactattcagtgactcggctatagtacgtcggtccncagtctggtacgggaaggcgtggaggtcgtcgttggccgttagttaacgaaacccaaacgtacggaacaaggtaccgacgtaactaagtttagngctggtccgttcggtacgacgtaacggccgtacggttaccaacgtacgtcctaccgagtagtagtcgtagttacgaagaaacggtaaccgacggtacgttaactcgtacgactaaagtacgaaaccgacgtaacccgtaaacggaaaaccgacggaaaccgaccgggttacgtacgttacgttaaccggttggaccgaccgtaagaccgttaccgttaccgttacgtttaacgttaccgttttacgttttacgtacggtttacggtacccg

SEQ ID NO: 59922 - DNA, 558 bp, Homo sapiens
  misc_feature: GYAE6OF02HEZ82.26.57.F02.1.454.CMB.1.raw
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctctggattcacattcagtgactcggctatatactgggtccgccagtctggccgggaaggctggagtggcttggccgtattagaaccaaacgtgaacaagtacgcgacaatttangctgcgtcggtgcaaggcaggtcaccatctccagagatgattcagaagaacgacggacgtatctgacaaagtacgaacacgaccgtaagaaaccgacggacgaccggtcgtagtacgttacgtgtcgaccagactacgtccgtacgttacttacgttatttttacgtacgttcgtacccg

SEQ ID NO: 59923 - DNA, 597 bp, Homo sapiens
  misc_feature: GYAE6OF02I5BUG.26.57.F02.1.454.CMB.1.raw
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaggtgtccagtgtcaggtgcagctggtggaggtccgggggaggcttggtccgaggccggggggtccctaggaaacctctcatgtgcaggctctggattcgacattcagtgactcggctatatactgggtcccgctagtctcggtaccgggaaaggccgtagggacgtgggcgtttgggccggttattaggaaccaaaccgtgaacaagtaccgacgtaacaatttaactggactaggcgtcggtgacaaggccaggttacaccatctaccaganagtgacttgaagagaacncggacgtatctacgacaaacgtagaacacgcgtaacgaaacgaacggacgaccggacgtagtacttacgtagtcgaccacgtacacgttacgtcgttaacgttacgttacttttacgtacgttcgtaccg

SEQ ID NO: 59924 - DNA, 699 bp, Homo sapiens
  misc_feature: GYAE6OF02H9TQK.26.57.F02.1.454.CMB.1.raw
  modified_base (327)..(327): a, c, t, g, unknown or other
  misc_feature (327)..(327): n is a, c, g, or t
  modified_base (425)..(425): a, c, t, g, unknown or other
  misc_feature (425)..(425): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtgggaggtccggggggaggtcgttggtccgagggcccggggggggtccctaggaaacctctcgatggtcgcaggctcgtggacttcactattcagtgactcggactatattaccgtgggtccnccgagtcgtggaccgggaagggctagggagtggcgttcggaccgttagttaacgaaaccgtaaacctaggaacaacggtaccgacgtaacaaatttancgctcggcgtcgggtcacgaacggcgtaggttaccacctacgtacctaccgaagacgtagtagtacttacgaacggaacgaaaccgacgggtacgtacgtaccgtagactaaaacgtaacgaaacgacgtaacccgttaacggaaaacccgggtaacggaaccggaaccgggtaccgtacgttacgttaccggtcggtaacggaccgtacgaacctaccgtaccgttacgttaacgttacgtttaacgtttttacgtacggttccgttacccgg

SEQ ID NO: 59925 - DNA, 651 bp, Homo sapiens
  misc_feature: GYAE6OF02JFG7Z.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaggtgtccagtgtcaggtgcagctggtggagtccgggggaggcttggtccaggccgggggggtccctgaaactctcatgtgcaggctctggattcacgattcagtgactcggctatatactgggtccgccagtctgccgggaaaggctggagtcggcttggccgtagttagaaccaaaccgttgaacaagtacgacgaactaactttatacgcgtagcggtcggtcgacaacgggctagggtttacaccctatccgtaccgagacgtatcgattacgaaggacgaaccgacgggacgttatactagactaaagtacgaaacgtacgacccgtaacggaaaaccgacgggaaaccgaccgggtaccgttaagttacgtttacgtacggtacgacccgaacgtaccgacgtttaccccggttacgtttaacggtttaaccgtttacgttttttaccgtacggtttacggttaaccccg

SEQ ID NO: 59926 - DNA, 681 bp, Homo sapiens
  misc_feature: GYAE6OF02JXPW1.26.57.F02.1.454.CMB.1.raw
  modified_base (662)..(662): a, c, t, g, unknown or other
  misc_feature (662)..(662): n is a, c, g, or t
tcagagactatactcacgaccggtgctcgatttagctcgatatagttgggtttggggtcgtgggagaggaggctccagccttgggattcccagctgtctccactcggtcgatcggcactgaatacaagagactcaccatggagtttgggctgagcgtgggtttcctgtgcttatttaaaaggtgtaccagtgtcaggtgcagctggtggaggtcccgggggaggcgttggtccagggccggggggtccctggaaactcgtcatgtgacaggctcgtgattcactattccagtcgactcggctagtatactcgggtcccgccagttcgcggtaccggggaaaggtcgtggacggtggccgttgggacccgttaagtaacggaaacctaaccgtagaacgaacgtacgggccaacgtaacttttacgcggtactcgtcggtcggttaacgacgtaaggccgtaggtccgtacccgtaactccgacgtaagagtacgtgtacttacgaacgaacgtaacggaccggtacgtacgtaccgtaggtaaaccctaaagttacgaaaccggacttacccgaaacggtaaaccgaacgtaaccggacccggttaacgtctaacgttcgtacgtcgtaacagacctacgtaccgtacggttataccggttntttacgtcgttaccgtacg

SEQ ID NO: 59927 - DNA, 649 bp, Homo sapiens
  misc_feature: GYAE6OF02IWHNL.26.57.F02.1.454.CMB.1.raw
  modified_base (310)..(310): a, c, t, g, unknown or other
  misc_feature (310)..(310): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtgggttttccttgttgctattttaaaaggtgtccagtgtcaggtgcagctggtggaggtccgggggaggcgttggtccgaggcccgggggggtccctggaaactctcatgtgcaggctctggattcactattcagtgactcggctatatactggtccncagtctggaccgggaaggctggagtggcttgggccgttataacgaaccaactagacaagtacgacgtactaattatgctgcgttcggtgacgaaggcacggtacacctctctaccagacgagtagtacttacaagaacgtaacgacggtacgttacgtactacgtaacaacgtacgaaaccgacgaacccgtaacggtaaaaccgaacgggaaaccggaacccggtaccggttagttacgtttaacgttcggtaccgacccgtaacggtacctaaccgttaccggttaccggttaacttttaccggttaattttttccgtacggtttaccggtacccgg

SEQ ID NO: 59928 - DNA, 551 bp, Homo sapiens
  misc_feature: GYAE6OF02F4QWB.26.57.F02.1.454.CMB.1.raw
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttggtccaggccgggggggtccctgaaacctctcagtgtgcgaggctcgtggattcacnttcagtgactcggctatatacgtgggtccnccaggtctggaccggggaaggctggagtggcttggccgttatacgaaccaactgacaagtacgcgacaatttangctgcgtcggtgcaaggcaggttcacatctcaganatgacttgagagacacggccgtatcgtanacaatagaacngaccgtacgaaaccgagaccgacggcgtagtactacgtgtcgacagactacgtccgtagtacgtttacgttatttttcacgttcgtacccgg

SEQ ID NO: 59929 - DNA, 617 bp, Homo sapiens
  misc_feature: GYAE6OF02I90SK.26.57.F02.1.454.CMB.1.raw
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctggaaactctcgatgtgcaggctctggattcacattcagtgactcggctatatactgggtcccgccagtctcgccggggaaaggcgtgggagtggcttggaccgtattagaaccaaactgaacaagtacgcaataattangctgcgtgngcaaggcaggtcacatctacagagatgattcgaagtacgaacacggacgtaactctacgacgaaagttacgaacaacgtaccgtaacggaaaaacccgtagggaaccgaaccgggtaccgtaggttaacgtttacgtacggttcgaccgaacgtaaccgtacgttaccgttacggtttaactttaacggtttaacgtttttttaccgtacgggttcggttaccccg

SEQ ID NO: 59930 - DNA, 565 bp, Homo sapiens
  misc_feature: GYAE6OF02FXU48.26.57.F02.1.454.CMB.1.raw
  modified_base (460)..(460): a, c, t, g, unknown or other
  misc_feature (460)..(460): n is a, c, g, or t
tcagagactatactcacgaccggtgctcgatttagctcgatatagttggggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggggtccctggaaacctctcatgtgcaggctctggattcacattcagtgactcggctatatactgggtccgccagtctggccgggaaagggctggagtggcttggccgtattagaaccaaactgacaagtacgcgaacaatttatgctgcgtcggtgcaaggcaggttcaccactctcagagatgatacagacgaacgacggcgtatctgacaaactagaanacgactaggaaaaccgaggaacgacggaccgtgtattactggtcgaccacgactagtccggttacgttacgtttacgttattttttacgacggttacggtacccg

SEQ ID NO: 59931 - DNA, 600 bp, Homo sapiens
  misc_feature: GYAE6OF02IFM36.26.57.F02.1.454.CMB.1.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctctggattcacattcagtgactcggctatatactgggtccnccagtctggccgggaaaggctggagtggcttggccgtatacgaaccaaacctgacaagtacgcgacaatttangctgcgtcggtgacgaaggcaggttcaccactctccagagatgattcagaacgaacgacggacgtactcgtagactaaatagaacacgacctacggaaaaccgaggaaccgaccgggaccgtagtacgttacgtcggtacgaccgacgaaccgtacgttacccggttaccgtttaacgtttaaccgtttacgttttttaccgtacggttacggttaccccgg

SEQ ID NO: 59932 - DNA, 655 bp, Homo sapiens
  misc_feature: GYAE6OF02FHBV4.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagctggtccagccggggggtcctgaactctcatgtgcaggctcgtggattcacattcagttgactcggctatatactgggttccgcctagccttggccgggaaagggctgggagtggcttgggcccgttatacgaaaccaaacctgacaagtaccgacgaaccaaattttacaggcgtaggtacgtcgggtagaccgtaagggccgtagggttccaccgtaactccgtaccagtacgagtagtagttaccaaggacgaaacgacggtaccgtatccgtacgacaaagtacgaaacgacgtaccctaacggtaaaacccggaggaacccgaacgggtacccgttaggttactacgtcggttaacgccaacgtaccgtaccgttaccggttacgttaacgtttaccgtttacgttttttaacgacggttacggttaccccg

SEQ ID NO: 59933 - DNA, 586 bp, Homo sapiens
  misc_feature: GYAE6OF02HB2AX.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccgaggccgggggggtccctggaaacctctcatgtgcaggctctggattcacattcagtgactcggctatatactgggtccgccagtcgtgccggggaaagggctgggagtggcgtggccgtattacgaaccaaacctgaacaagtacgacgaactaattatgctgcgtggtcgacgaaggctacgtacaccatcctacgagagtatgtattacgaagacgaacgacgacgtactctagacaaagtacgaacagaccgtaacgaaaccgacgacgaccggtcgtagtacgttacgtcggtcgaccgaagacgtacgtcgtacgttacgttacgtttacttttacgtacgttcgtacccg

SEQ ID NO: 59934 - DNA, 931 bp, Homo sapiens
  misc_feature: GYAE6OF02IO8R0.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagcgtggtggaggtcccgggggaggtcgttgggtccgacgggtcccggggggggttcccctcggaaaaccttccgtactaacgttggtacggtacgacgggtccttccgttagggtactttaccgaacctaagtttccgaacggttcggtaacccgttccggggtaccttaaggtttaacgttaccggttaccggggggttcccccggtacccgtaacggttccggtacggggaacccgggggggtaaaacggggtaccggttagggggacggtttacggggtacccgtttgggtaaccccggtttaagttaaccggtaaaaccccgtaaaacccgtacggtaaaccgtaaacggttaaccggaccgttaaactaaacgtttttacgtacgttaccgttacgggtccgggtttacggggtacggtaccggtaacgggtaccgtaacgggtttccaaaccccgtacgttacccgtcccgtaaggtacgtaacgttcgggtaaacttccgaaaggtaaacgtaaccccgggtaacggtaccgttacgtaccgtacggaacgtaaacgtaacggtaaccgtaaccgtacccgtaacggaaaacccggaacggtaccggtaaccgggtaccgttagtttacgttaccgttagggcctaccgtaacggtaacaccgttaccggtttaccggtaacgttttaccggtttactttttacgtacggttacccgttacccgg

SEQ ID NO: 59935 - DNA, 589 bp, Homo sapiens
  misc_feature: GYAE6OF02HLAVE.26.57.F02.1.454.CMB.1.raw
  modified_base (381)..(381): a, c, t, g, unknown or other
  misc_feature (381)..(381): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggagcttggtccgaggccggggggttccctgaaactctcatgtgcaggctctggattcacattcagtgactcggctatatacgtgggtcccgccagtctggaccggggaaggccgtgggagtggcttggccgttattacgaaccaacctgacaagtcgcgactaattngctgcgtcggtgacgaaggcgacgttccactactcctacgagagatgtattacgagagaacgacggacgtatctagacaatagaacacgaccgtacgaaaccgaggaccgacggtaccgttacgtacgttacgtcggtacgaccgtacgaacctacgtacccgttacgttaacgttacgtttacgtttttacgtacggttcgtacccg

SEQ ID NO: 59936 - DNA, 680 bp, Homo sapiens
  misc_feature: GYAE6OF02JSE82.26.57.F02.1.454.CMB.1.raw
  modified_base (413)..(413): a, c, t, g, unknown or other
  misc_feature (413)..(413): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgtctattttaaaaggtgtccagtgtcaggtgcagcgtggtggagtccgggggagcgttggtccgaggccggggggtcctaggaaactctcagtgtgcaggctcgtggattcgactattcagtgacgtcggacttatatacgtcgggtccgcgtagtctcggaacgggaaggcgtaggacggtggcgttggccttaagtaacgaacctaaacgtgaaccgtaagtaccgacgtaaactaacgtttancgtacgttcgacggttacggtacgacgtaaaggtccgtaacggttaccaacccgtagtccgtaccgaagtaagtagtaagtacttacgaacggaacgaaacgtacggaccgttattacgacgtaacgtaaatacgtaaacgacgtaaccgaaacgtaaaccgacggaaccgacggtccgtaagttacgttacgtcggacgtaccgacgtaacgtaccgtacgttacgttaacgtttaccgttattttacgacggttccgttaacccg

SEQ ID NO: 59937 - DNA, 579 bp, Homo sapiens
  misc_feature: GYAE6OF02FNT28.26.57.F02.1.454.CMB.1.raw
  modified_base (385)..(385): a, c, t, g, unknown or other
  misc_feature (385)..(385): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctcgtggattcacattcagtgactcggctatatactgggtccgccagtcgtggaccgggaaagggctgggagtggcgttggccgtattacgaaccaactgacaagtacgcgaactaatttangctgcggtcggtgacgaaggcgacggttcacctatcctccgagagatgatcagagaacgacggtcgtatcgtagacaaatagacacgacctaacgaaacgacggacgacgaccgtagtattacgtacggtgaccgacgtacctagttcccgttacgttacgttaccggtttaatttttcgtagttcggtacccg

SEQ ID NO: 59938 - DNA, 565 bp, Homo sapiens
  misc_feature: GYAE6OF02IJKGF.26.57.F02.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctctggattcacattcagtgactcggctatatactgggtccnccagtctgaccgggaaggctggagtggnttggcgtattacgaaccaaactgacaagtacgcgactaatttangctgcgtcggngcaaggcaggttcacatctacagagatgattcaagagaacgacggacgtatctgacaatagaacacgacctacgaaaccgacggaacgaccggaccgtagtacgttacgtgtcgccaagaacctacgttaccgtacgttacgtttacgttacttttttacgtacgttacggtacccg

SEQ ID NO: 59939 - DNA, 586 bp, Homo sapiens
  misc_feature: GYAE6OF02GRTWW.26.57.F02.1.454.CMB.1.raw
  modified_base (305)..(305): a, c, t, g, unknown or other
  misc_feature (305)..(305): n is a, c, g, or t
  modified_base (386)..(386): a, c, t, g, unknown or other
  misc_feature (386)..(386): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctcgtggattcacattcagtgactcggctatatacgtgggtccnccgagtctggccgggaaaggcgtgggaggtggcgttggccgtagttacgaaccaacctgaacaagtacgcgataatttagngctgcgtcggtgcgaaggcgtaggttcacctactcctaccagagagtacgtatcaaggaacgaacgacggacgtatctagacaagtagaacgagacctaacgaaacgacggaaccaacggtacgtagtacgttacgtaggtcgaccgagtacacgttccgtacgttacgttacgttagtttttacgtacgttcgttaccg

SEQ ID NO: 59940 - DNA, 559 bp, Homo sapiens
  misc_feature: GYAE6OF02GE916.26.57.F02.1.454.CMB.1.raw
  modified_base (425)..(425): a, c, t, g, unknown or other
  misc_feature (425)..(425): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcgttggtccaggccggggggtccctgaaactctcatgtgcaggctctggattcacattcagtgactcggctatatactgggtccgccaggtctgccgggaaggctggagtggcttggccgttattacgaaccaaacctgacaagtacgcgacaatttatgctgcgtcggtgcgaagcgaggttcacatctccgagagatagacttnagacgaacgacggacgtatcgtagacaagtagaacacgacctacgaaaccgagaaccgacggccgtagtacttacgtagtcgaccacgacacgtccgtacgttacttacgttatttttcgtacgttcgtacccg

SEQ ID NO: 59941 - DNA, 617 bp, Homo sapiens
  misc_feature: GYAE6OF02HI6SZ.26.57.F02.1.454.CMB.1.raw
tcagagactatactcacgaccggtgctcgatttagctcgatatagttgggtttggggctgggagaggaggggctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccaggccgggggggtccctgaactttcatgtgcaggctcgtggattcacattcagtgactcggctatatactgggtccgccagtctggccgggaaagggctgggagtggcgtggccgtattagaaccaaacctgaacaagtacgcgaactaatttatgctggtcgtcggtgcgaaggctaggtcacctatctccagagatgattcgagaagaacgacggacgtagtctgacaaagtcgaacacgacgtacgaaaccgaacggaaccggaccggaccggttagttacttacgtcggtaccgccgaacgtacgtaaccgttaccgttaccggtttaacgtttaaccggtttagttttttaccggtaggtttccgggttacccgttaaccggg

SEQ ID NO: 59942 - DNA, 556 bp, Homo sapiens
  misc_feature: GYAE6OF02GF3GU.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactggtccgccagtcgtggccgggaaaggcgtggagtggcttggccgtattacgaaccaacctgacaagtacgcgacaatttangctagcgtcggtgacaaggcaggtcacatctcagagatagatcgagacgaacacggacgtatctagacaaagtagaacagaccgtagaaaaccgaggacgaccggaccgttagtacttacgtgtcgaccagactactacgtacgttagttaccgttagtttttactacggttcgtacccg

SEQ ID NO: 59943 - DNA, 698 bp, Homo sapiens
  misc_feature: GYAE6OF02I21VP.26.57.F02.1.454.CMB.1.raw
  modified_base (399)..(399): a, c, t, g, unknown or other
  misc_feature (399)..(399): n is a, c, g, or t
tcagagactatactcacgaccggtgctcgatttagctcgatatagttgggtttggggcgtgggagagggagctccagccttgggattcccagctgtctccactcggtgatcggcactgaatacaagagactcaccatggagtttggctgagctgggtttccttgttgctatttaaaggtgtccagtgtcaggtgcagctgggtggaggtccgggggaggtcgttggtcccgaggcccgggggggtccctaggaaacttctcgtatggtgcgaggtctcgtggtactcacgattcgaggtgacgtcggcctatagtacgttcgggtccgaccgtagtcgtcggaccgggaaagggtcgtaggtaggtggcgttgggccgtaagttacgaaacctaaacgnggaacaaagtctacgaacgtaatttggctacgtgcggtcggtaggaccgaaggtccgtacgggttaccacgtatccgttacgaaggtagagtcgagttacgaaggtacgaaacgacggtacgtattcgacgaactaaagtacgtaaacaccgtaccgtaaacggaaaaccgggagaaaccggaccgtaccgtaagttaccgtttagtacggtacgaaccggtacggtaacctacggttaccccggttagttactttaaccggttttacgttttaaccggttacggttaccggtacccgg

SEQ ID NO: 59944 - DNA, 547 bp, Homo sapiens
  misc_feature: GYAE6OF02I5AWZ.26.57.F02.1.454.CMB.1.raw
  modified_base (391)..(391): a, c, t, g, unknown or other
  misc_feature (391)..(391): n is a, c, g, or t
  modified_base (426)..(426): a, c, t, g, unknown or other
  misc_feature (426)..(426): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttccttgttgctattttaaaggtgtccagtgtcaggtgcagctggtggaggtccgggggaggcttggtccaggccggggggtccctgaaactctcatgtgcaggctcgtggattcacattcagtgactcggctatatactgggtccgccagtctggccggggaaagggctgggagtggcttggccgtatacgaaccaaactgacaagtacgcgactaagtttatgctgcgtcggtncgaaggcagtcaccatcctcagagatgatcgaganaacgacggcgtatctgacaagtagaacacgacgtagaaaccgaggaccgacggcgtagtactacgtggtcaccgagacacgtccgtacgtacgtttacgttattttcgtacgtcgttaccg

SEQ ID NO: 59945 - DNA, 573 bp, Homo sapiens
  misc_feature: GYAE6OF02G8OU6.26.57.F02.1.454.CMB.1.raw
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccgggggggtccctgaaactctcatgtgcaggctctggattcacattcagtgactcggctatatactgggtccgccagtctggccgggaaagggctggagtggctggccgtattacgaaccaacctgacaagtacgcgacaatttangtctgcgtcggtgcaaggcaggttcaccatctccagagatagatcaagagaacgtacggcgtaatcgtcgacaaagtacgaacacgacctaacgaaaccggacggaacgacggaccgtagtacttacgtgtacgaccagaccgtacgtccgttacggtactttacgttaactttttcgtacggttcgttaacccg

SEQ ID NO: 59946 - DNA, 624 bp, Homo sapiens
  misc_feature: GYAE6OF02GQ20U.26.57.F02.1.454.CMB.1.raw
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtgggttttcctgttgctatttaaaaggtgtccagtgtcaggtgcagctggtggagtccgggggagcttggtccaggccgggggggtccctgaactctcatgtgccaggctcgtggattcacattcagttgactcggctatatactgggtcccncagtctggccgggaaagggctggagtggcgtggccgtatacgaaccaacctgacaagtacgcgacaatttangctgcgtcggtgcgaaggcgtaggtcacactcctccagagatgattcagaacgaacgtacggcgttagtcgtacgtactaaagtagaaactacgaccctaacggaaaacccggtaacgggaacccgtaaccgggacccgttacgttacgtttacgttcggtacggtacccgaacgtaaccgtaaccgttcccggttaccgttacgtttaccggtttaacttttttacgtaccggttcggttaccccg

SEQ ID NO: 59947 - DNA, 638 bp, Homo sapiens
  misc_feature: GYAE6OF02HKHND.26.57.F02.1.454.CMB.1.raw
  modified_base (309)..(309): a, c, t, g, unknown or other
  misc_feature (309)..(309): n is a, c, g, or t
  modified_base (396)..(396): a, c, t, g, unknown or other
  misc_feature (396)..(396): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctggaaactctcatgtgcaggctcgtggattccactattcagtgactcggctatatactgggtcccnccgagtctggaccgggaaagggctgggaggtggcgttgggcgttagttacgaaaccaaacctgaacaaggtacgcgaactaatttangctgcgtcggtgacaagggctaggttccacctatcctcgagagatagacttcgaagacgaacgacggcgtactcgtacgactaaagacgaacgacgaccgtaacgaaaacccggaggaaccaccgggtaccgttaggttactttacggttacggtaccgaccgtaacgtaccgtacgttacccggttacgtttaacgtttaaccggtttacttttttacgtacggttaccggttaaccccgg

SEQ ID NO: 59948 - DNA, 629 bp, Homo sapiens
  misc_feature: GYAE6OF02INC7A.26.57.F02.1.454.CMB.1.raw
  modified_base (395)..(395): a, c, t, g, unknown or other
  misc_feature (395)..(395): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcgttggtccaggccgggggggtccctgaaactctcatgtgcaggctctggattcactattcagtgactcggctatatacgtgggtcccgccaggttctggccggggaaaggctgggagtggcttggccgtattagaaccaactgacaagtacgcactaatttatgctgcgtcggtncgaaggcgtagttcaccactctccgagagatgtattacgaagaagaacgacggtacgttactccgtagacgtaaagtagaacgacgaccgtaacggaaaacccgaagggaaccgaaccgggtccgttaaggttacgtttaacgtcggttacggaccctaaggaacctacgtacccggttacgtttaaccgtttaaccgtttacgttttttacggtacggtttcggttaacccgg

SEQ ID NO: 59949 - DNA, 618 bp, Homo sapiens
  misc_feature: GYAE6OF02F3EBO.26.57.F02.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggtcgttcgtgtagctcttaagtgcagtgtnagtncagctgtggagtccgggnggcttgccagcgggggtccngaactctcagtgcgcaggtctgtggattcacagttcaagtgactcggctatagtaccttgggccacctaggtcttgggcccggtaaaggcgtggagtcgggctttggccgtattaacgacaaacctgaactaagtacgcgactaaattgtgactgcgtcggtgaccgaagtcaggttcaccctatccgtccagagattaggacttacgtagaacggactaacgggtaccgtaagttcacggtaacccgttaaagtacgaacgtacgtaccgaacggtaaaccggaacggtaaccggacggttaccgtagttacgttacggtacgtaccgacgtaacgaccgtaacgttaccgttacgttacgtttacgttattttaccggtacgttccgtaccg

SEQ ID NO: 59950 - DNA, 624 bp, Homo sapiens
  misc_feature: GYAE6OF02JJUVO.26.57.F02.1.454.CMB.1.raw
  modified_base (291)..(291): a, c, t, g, unknown or other
  misc_feature (291)..(291): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccagccgggggggtccctgaaactctcatgtgcaggctctggattcacattcagtgactcggctatntactgggtccgccagtctgccgggaaggctggagtggcttggccgtattacgaaccaacctgaacagtacgcgaactatttacngtactggccgtcggtgaccgaaggcgacggttcaccgatccgtcaganacgtagacttacgaggaacgaaccgacgggtccgtactcgtcgacaaacgtagaaccacgacccgtaacgtaaaacccgaagggaaccgaccgggtaccgtagttacttaaccgtacggtacggtacccgaacgtaaccgtacgttacccgttacgttacgtttacccgtttactttttacgtacggttacggtaaccccg

SEQ ID NO: 59951 - DNA, 618 bp, Homo sapiens
  misc_feature: GYAE6OF02IP615.26.57.F02.1.454.CMB.1.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccnccagtctggccgggaaaggctggagtggcttggccgtattacgaaccaactgacaagtacncgactaatttatgctgcgtcggtgacgaaggcgaggtcaccatctccagagatagtattacgagtaagaacgacggacgtatctgacaaatagaaccagaccgtaacggaaaacccggaagggaaccgaaccgggtacccggtagttacgttaacgttacggtacggtacccgtaacgaacctacgtacccggttaccgttaacgttttaaccgttaacgtttttttaccgtacggttaccggttaaccccgg

SEQ ID NO: 59952 - DNA, 660 bp, Homo sapiens
  misc_feature: GYAE6OF02HHD11.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcctgttgctatttaaaggtgtccagtgtcaggtgcagctggtggagtccgggggaggcttggtccaggccggggggtccctgaaactctcatgtgcaggctctggattcacctattcagtgactcggctatatacgtgggtcccgccagtctggaccggggaaggcgtggagtggcttgggaccgttagttaacggaaccctaaaccgtgaacaacgtacgacgaactaaatttatgtctaggcggtcggtgcgaacgggtcgacggtttacaccgtacttccgtaccaaggacgatagtattacgaaggtaacgaaccgacggtacgttaatcctacggtaacaaagttacgaaacgtaacgaccgtaacggaaaaccggaacgggaacgtaaccgggtccgtaagtacttaacgttcggttacgaccgtacgtaacgtaccgttaccgttacgtttaacgtttaaccgtttattttttaccgtacggttcggttacccgg

SEQ ID NO: 59953 - DNA, 685 bp, Homo sapiens
  misc_feature: GYAE6OF02HF50Q.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagctggttttccttgttgcttattttaaaaggtgtcagtgtcaggtgcagctggtggaggtccgggggaggcttggtccgaggcccggggggtccctagaactctcagtgtgcaggctcgtggattcactattcagtgactcggactatatacgtgggtcccgcgagtccgtggaccgggaagggcgtgggcgtggcgttcggccgttaattacgaaccaaccgtgaacagtacgcgtaactaagtttagtgcttcggcgttcggtagacgaacgggtcgtaacgggttcaaccctacgtcctaccgaaggagtatacgtattacgaaaggtaacgaaaccgacgggtacgtaacgttcgtacgaacgaaacgttacgaaaccgtacgtaacccgtaaggaaaaacccgggacgggaaacccgtaaccgggtccgtaaggttacgttaacgttacggtcgaccgtaggtaaccgtaccgttaccggttaccgttaacttttaccgtttaacgtttttccgtacggttaccgtacccgg

SEQ ID NO: 59954 - DNA, 845 bp, Homo sapiens
  misc_feature: GYAE6OF02IC2KU.26.57.F02.1.454.CMB.1.raw
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgctattttaaaaggtgtccagtgtcaggtgcagctggtggaggtccgggggagcgttgggtccgaggtccggggggtcctaggaaactctcatgtgnaggctgtggattcacattcagtcgactcggctatatacgtcgggttcccncctagtccgtaggacccggggaaagggtctgggacggtgggtccgtttcgggaccgttaattacggaaaccctaaaaccgtagaaaccgtaaacggtaacggaccggtaaaccttaaagtttaacgttcggaccgttacggtaccggtttaccggggttacgaacggtaacgggtccgtaaggggttttacccaaacccgttacgttcccgttaaaccgaaggtaacgtaacgttagggttaacgtttacgaacggtaaacgtaaaccggtaaccgggttaccgttaacgtaccgtaacggtaactaaaacgtacggtaaaacgaccggtaacccgtaaacggtaaaaacccgggtaacgggtaaacccggaaccggggttaaccggttacggttaaaccgtttacggtaccggttaaaccggtacccgtaacggaaacccgtttcggtaaccccggtttacggttaaccgtttttaaccggttttaccggtttttttaccggtaccgggtttccggtttaaaccccggg

SEQ ID NO: 59955 - DNA, 688 bp, Homo sapiens
  misc_feature: GYAE6OF02H5RYQ.26.57.F02.1.454.CMB.1.raw
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgtgctatttaaaaggtgtccagtgtcaggtgcagctggtggagtccgggggaggcttggtccaggccgggggggtccctagaaactctcagtgtgngaggctctggatcacattcgagtcgactggactatactacgtggtccnctagtcgtgacgggaaggctggagtggctggaccgtatacgaactaacgtgaacaagtacgacgacgtaattacgcgtcgtacgtcggtacgggtcgacgaaggcttagggtaccaacccgtacgttccgtaccgaaaggtacgtaagttacgtacgttacgtaacggtaacggtaaccgtaacgggtaccgttaagtccttaaggaacttaaagaacgtaaccgacgtaaccgtaacggtaaaaccgacgggtaaaccgaccgggtacgttaacgggttaccttaaccggtagtacccggaccgtaagacccgttaacgttcccggttacgtttaacgttacccggtttaacgtttttcgtaaccgggttccgttaacccggg

SEQ ID NO: 59956 - DNA, 747 bp, Homo sapiens
  misc_feature: GYAE6OF02JNICQ.26.57.F02.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggngtccgggggagctggtccaggccggggggtcctgaaactcncatgtgcgaggctcgtggtacttcgactattcgaagttcggacgttccggtacttagttacgtaccgttcggggtcccgaccgtaggttccgtcgggacccggggtaaaaggggtcccgtaggggacggttcgggcgtttacgggccgtttaagttaacggaaaaccctaaaaccgtgaaccgaaacgggttaccaccggtaaacctaagttttaacggtaggtccgttaggccgggttacgggtacgacggtaaacggtccgtacgggttaccctaacccggtaacttaccgtacccgaaggacggtaattggtaacgttacgaacggtacgaaacgaacgggtccgttaagtcagtaactaaagtacgaacacgtaaccgaacgggtaaacccgaaggaccgaaccggtaccgtacgtacgttacgtacggtacgtaccgaacgtacaaccgttaccgtacgttagttacgttcgttttacgtacgtacgtaacccgg

SEQ ID NO: 59957 - DNA, 559 bp, Homo sapiens
  misc_feature: GYAE6OF02F6DQN.26.57.F02.1.454.CMB.1.raw
  modified_base (384)..(384): a, c, t, g, unknown or other
  misc_feature (384)..(384): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggagtccggggggaggcttggtccaggccgggggggtccctgaaacctctcatgtgcaggctctggattcacattcagtgactcggctatatactgggtcccgcagtctggccgggaaagggctgggagtggcttggccgttattacgaaccaaacctgacaagtacgcgacaatttangctgcgtcggtgcgaaggcaggttcaccgatctcagagatgatcagaagacacggcgtatctagacaaagtagaacgacgaccgtaagaaaaccgaaggaccgacggcgtagtattactggtcgaccagactacgtcgttacgtattaccgttatttttcgtagttcggtacccg

SEQ ID NO: 59958 - DNA, 697 bp, Homo sapiens
  misc_feature: GYAE6OF02I0RIE.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcgttggtccgaggccggggggtccctagaaacgtctcagtgtgcgaggctcgtggattcacattcagtgacgtcggctatataccgtgggtcccgccagtcgtcggaccgggaaagggctgggagtggcgttggccgttattaacgaacctaaacgtgaactaacggtacgcgtaactaagtttgcgtacgtgtccggtcggtcggacgaacgggtcgtaacggttacccaaccgtaacttccgtacccaggtacgtaagttacgtagttaccgaggtaacgaaaccgacgggtaccgttaacgttacgtaggtacctaaagttacgaaaccgtaacggaccgtaacgaaaaccggacggaaccgaaaccgggtcgttaacgttacttaccggtacgtcggtaccgaacgtaaccgtaccgttacccggttacgttacgttaaccgtttacgttttttaccgtacggttcggttacccg

SEQ ID NO: 59959 - DNA, 651 bp, Homo sapiens
  misc_feature: GYAE6OF02I1ERK.26.57.F02.1.454.CMB.1.raw
  modified_base (389)..(389): a, c, t, g, unknown or other
  misc_feature (389)..(389): n is a, c, g, or t
  modified_base (406)..(406): a, c, t, g, unknown or other
  misc_feature (406)..(406): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcagtgcagctggtggagtccgggggaggcgttggtccaggccggggggtcctgaaactctcatgtgcaggctcgtggattcacattcagtgactcggctatatactgggtccgccagtctggacccggggaaaggctgggagtcggcgttggccgtagttacgaaacctaaactgaacaaagtccgacgtactaatttancgctagccggttacggngtacaaacgggctagggttaccacccgtactcctaccaaggtacgtatcggtaatacgaaggtaacgaaaccgacggtacgttactacgtacgaactaaagtacgaaccaacgaccgtaacgaaaaccggaacggaaccgacgggtaccgttaaggttacgttacgtacgtcgtaccgaacgtaactacgttcccggttacgttaacgttaccgtttaattttttcggtacgttcgttaacccgg

SEQ ID NO: 59960 - DNA, 645 bp, Homo sapiens
  misc_feature: GYAE6OF02HX29P.26.57.F02.1.454.CMB.1.raw
  modified_base (417)..(417): a, c, t, g, unknown or other
  misc_feature (417)..(417): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctattttaaaaggtgtccagtgtcaggtgcagctgggtgggaggtccgggggaggcgttgggtccgagggcccgggggggtccctggaaacctctcatggtgccaggtctcgtggattcacattcagtgactcggctatatacgtgggtcccgccaggtctcggaccggggaaagggcgtgggaggtgggctttgggaccgtattacggaaaccaaaccgttgacaaaggtaccgacgaactaatttangtctgcgtcggtgcgaacggctaggttaccaccatctacagagatgtattcaagaagaacaccggcgtatctagactaaagcgaacacgaccgtagaaaaccgaacggaaccgacggtccgtagttacttacgtacggtcggaccaacgtactaccgttacccggttacggtttaacgttttaaccgttttaacgttttttaccggtacggttaccggttaaccccgg

SEQ ID NO: 59961 - DNA, 644 bp, Homo sapiens
  misc_feature: GYAE6OF02I2AZJ.26.57.F02.1.454.CMB.1.raw
  modified_base (312)..(312): a, c, t, g, unknown or other
  misc_feature (312)..(312): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttcctgttgctatttaaaaggtgtccagtgtcaggtgcagctggtggaggtccgggggagtcttggtccaggccggggggtccctggaaactctacatgtgcaggctctggattcacattcagtgactcggctatatactgggtccgccgagtcgnggccgggaaagggctggagtggcgttggccgtataccgaaaccaaactgaacgaagtaccgacgtactaatttactgactgccgttcgggtgcgaaaggcgtacggttcaccgtacgtactccgtaagacgatacggtagttaccgaacggtaggaaccgtaaccgggtccggttacttcgtacgtaacctaaagtacgaaacgacggtacccgtaaacggaaaaccgaacggtaacgaccggtaccgttagttacgttacgtaggtcgaccgacgaactacgtaccgttacgttactttacgttacgtttttacgtaggttccggtacccg

SEQ ID NO: 59962 - DNA, 549 bp, Homo sapiens
  misc_feature: GYAE6OF02FWIPI.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtccgccagtctggccgggaaagggctgggagtggcttgggccgtattagaaccaaacctgaacaagtacgcgacaatttatgctgcgtcggtgcaaggcagttcaccgatctcagacgatgattacagagaacacggcgtatctgacaaatgaacagacctagaaaccgaagacgacggcgtagtacgttactgtcgaccgagactacgtaccgtacgttagttacgttatttttacgtgttcggtacccg

SEQ ID NO: 59963 - DNA, 546 bp, Homo sapiens
  misc_feature: GYAE6OF02IWZPY.26.57.F02.1.454.CMB.1.raw
  modified_base (374)..(374): a, c, t, g, unknown or other
  misc_feature (374)..(374): n is a, c, g, or t
  modified_base (435)..(435): a, c, t, g, unknown or other
  misc_feature (435)..(435): n is a, c, g, or t
  modified_base (493)..(493): a, c, t, g, unknown or other
  misc_feature (493)..(493): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggaggcgttggtccaggccggggggtccctgaaactctcatgtgcaggctctggattcacattcagtgactcggctatatactgggtccgccagtctgccgggaaaggcgtggagtggctggccgtattagaaccaaactgacaagtacgcgacaatttangctgcgtcggtgacaaggcagtcacatctacagagatgatcagaagaacacggacgtatcngacaaagtgaacacgacgtacgaaacgacggaacacggacgtacgtattactaggtcnccgtaagactacgtccgtacgtagttaccgtatttttacgtagttgttacccg

SEQ ID NO: 59964 - DNA, 582 bp, Homo sapiens
  misc_feature: GYAE6OF02HJSNS.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggaggcttggtccaggccgggggggtccctgaaactctcatgtgcaggctctggattcacattcagtgactcggctatatactggtccgccagtctggaccgggaaggctggagtggctggccgtattacgaaccaaactcgacaagtacgacgactaagtttatgctgcgtcggtgacgaaggcgaggtcacctatcctacagagatagattcagaagacgacggacgtatctagacaaatagaacacgacctaacggaaaccgagggaccgacggtaccgtagtacgttacgtacgtcgaccaacgtacgtacgttacccgttacgttaacgttacgtttactttttacgtacggttcgtacccgg

SEQ ID NO: 59965 - DNA, 562 bp, Homo sapiens
  misc_feature: GYAE6OF02FRHTD.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttgggtcccgaggcccggggggggtccctggaaacctctcatgtgcaggctctggattcacattcagtgactcggctatatactggtcccgcagtctgccgggaaggctggagtggcttggccgtattagaaccaacctgacaagtacgcgacaatttatgctgcgtcggtgcaaggcaggtcaccatctccagagatgattcagagaacacggcgtatctagacaagtagaacagcctaagaaaaccgaggaccgaacggtaccgtagtacgttactcggtcgaccgataccgacgttccgtacgttactttacgttatttttcgtacgttcggttacccg

SEQ ID NO: 59966 - DNA, 642 bp, Homo sapiens
  misc_feature: GYAE6OF02IDSHN.26.57.F02.1.454.CMB.1.raw
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
tcagagactatactcacgaccggtgctcgatttagctcgatatagttgggtttggggctgggagaggagctccagccttgggattcccagctgtctccactcggtgatcggcactgaatacaagagacctcaccatggagtttgggctggagcgtcggtttcgtgtaggctactttaaagtgtcagtgtcaggtgcagctggngngccggggagcttggcaggccggggggtccctgaaactctacgatgtgcgaggtctcgtggacttcactattcagtnctacgctataatcgtaggtcccactaacgttcgtacggaaccgggtaagggcttcgggagtcggccgtttaggaccgttaattaacgaaaccgaaacgtcgaaccaagtaaccggacgactaaattttacgcgcttacgcgttccggtgaacgaacggaccgtaaggtttaccaaccgtactttaaccacccgtaagaccgtaaggtagtaacctagaaacgaacgaaacgacggtacgtaacgttcaacgactaaagtagacgacgtacaagaaacgacgacgaccgtactagtacgttaacgtcgtcgaccagaccctagtacccgtgtaccttaagttacttttacgcgtagtacccg

SEQ ID NO: 59967 - DNA, 800 bp, Homo sapiens
  misc_feature: GYAE6OF02H3QGB.26.57.F02.1.454.CMB.1.raw
  modified_base (183)..(183): a, c, t, g, unknown or other
  misc_feature (183)..(183): n is a, c, g, or t
  modified_base (471)..(471): a, c, t, g, unknown or other
  misc_feature (471)..(471): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtagctatttaaagtgtcagtntcaggtgcagctgggtggaggtccggggggagcgttggtcgagggcccgggggggtccctaggaaacttctacagtgtcgcgaggctcgtaggtattacactattaccgtagtcgacctcggtactaagttagtacgtacgggtcccgacgtaggttcgacgggacccggggtaaagggtccgtagggtacggttcgggacttacgggtaccgttaagttaaaccggaaaaccccgaaagttacgtaaaccgtaaagggaccggtaactaaacggtttaaattttacncggtaacttggtaccggttcgggtaggaccgaaaggtcgtaacgggtaccaccgtacttccgtaactaacgagtagttagtacgttaacgaaccgaaggaaccggacggtaccttaagtaccgtaagttaaccgtaaagtaacggtaaaccgaaccgtaaccggtaacaaaaacccgggtacgggtaacccggaaccgggttaccggttaacgttacgtttaccggttaggtaccggaaccgttaggtaacgttacccgttaccgtttacgtttaacggttttaccggttttaccgttttttaacggtaccgtttacgggttaacccgg

SEQ ID NO: 59968 - DNA, 596 bp, Homo sapiens
  misc_feature: GYAE6OF02GB2UB.26.57.F02.1.454.CMB.1.raw
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggagtccgggggaggcttgggtccgaggccggggggggtccctggaaactctcatgtgcaggctctggattcacatttcaagtgactcggctatatactgggtccgccagtctggccgggaaaggcgtggagtggcttgggccgtattacgaaaccaaacctgaacgaagtacgcgaactaatttagtagctgcgtccggtgcgaaggcaggttacacatctccagagatgattcaagaagaacgacggacgtacnctagacaaanagaactacgacctacgaaaaccgaggaaccgacggccgtagttacgttactcggtacgacctacggaactacgttacccgttacgttaacttttaaccgttattttttacgacggttcgtacccg

SEQ ID NO: 59969 - DNA, 662 bp, Homo sapiens
  misc_feature: GYAE6OF02H56O3.26.57.F02.1.454.CMB.1.raw
  modified_base (329)..(329): a, c, t, g, unknown or other
  misc_feature (329)..(329): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaggtgtccagtgtcaggtgcagctgggtgggacggtccgggggaggtcgttcggtccgagggcccgggggggtccctaggaaacctctcgatgtgacaggtctctggattcactattcaggtgacctcggactatatacgtcgggtcccncagtcgtaggaccgggaagggctagggagtggtcgttgggaccgttatacgaaaccaaccgtgaaccgaagtcgacgactaattagcgtactgcgtcggtaggtacgacgtaggtaccaccgtatacctcgagacgtagtagtacttcgaagacgaacgacggtacgtaactcgtcgaactaagtacgaacgtaccgaccgtaaacgaaaccggacgaccggtaaccggacgttacgttaacgttacgttcggtacgcgtaacgaccgtacgttacccgttagtttacgtttaactttaccgtttttacgacggtttacccggacttaacggg

SEQ ID NO: 59970 - DNA, 695 bp, Homo sapiens
  misc_feature: GYAE6OF02H8GYD.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccgggggagtcttggtccgagggccggggggtccctgaactctcatgtcgcaggctcgtgacttcactattcgagtgaccgtcggactatacgttacgtcgggtcccgcctagtccgtcgggacggggaacggggctggggtacggtggtaccgttcgggtaccgttaagttaaacggaaaccccgtaaaccgttacggaaaccgtaaagtaccggaccgtaaacttaaacttttagcggtcgttcggaccgggttcgggtcgacggtaacggcgtaccggttacccgtacctacgtcctacgaaggtagagttacgtacgttacaaggaacgtaaccgacgggtacgttactcgagtactaaagtacgaacgtacgaccgtaacgaaaccgacggacgtaaccggctagttacgttagtcgcgaccgacgaaccgtactacggttacgttacgttacgtttagttttccgtacgtgtacccg

SEQ ID NO: 59971 - DNA, 847 bp, Homo sapiens
  misc_feature: GYAE6OF02HYER8.26.57.F02.1.454.CMB.1.raw
  modified_base (423)..(423): a, c, t, g, unknown or other
  misc_feature (423)..(423): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgtcttaagttttaaaaggtgtccagttgtcgaggtgcagcgtgggtgggacggtccggggggaggtcgttcgggtccggacggggtccccggggggggttccctaggaaaccttctacgtagttggtcgacgacggtcgttcgtggtacttcctaactatttcgtaaggtcgaccgttcggtactagttagtaccggtcgggtaccccgtaccgtacggttccggtcgggtaaccgggggaaggtccggtagggnggttcggggttcgttacgggtaccgttaacgttaaacggaaaaccccgtaaacgtacggaaaccgtaaaccggtaccggtaaccggtaaacttaaagttttacgtacgttacgtcggtcgggttacggtcggaacgggtaacgggtccgtacggttaccgtaaccctacgttccgtaaccgagtaacgtaagttaggttacttacggaaacgtaaacggaacgtaccgggtaactacgtcctaagtaactaaacgtacaaacgtacgtaaccgtaaaccggaaaaccggaacggtaaccggtaaccggtaccggttaagttacgtttaccgttacggtaaccgtaccgtaacgaaccgttaccgttaccgtttaacgttaacggtttactttacggtttttacgttaccggttccggttaccgg

SEQ ID NO: 59972 - DNA, 615 bp, Homo sapiens
  misc_feature: GYAE6OF02FRK1V.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccggggggaggcttggtccaggccgggggggtccctggaaactctcattgtgcaggctcgtggattcacattcagttgactcggctatatactgggtccgccagtcgtggccgggaaaggcgtggaggtggcgttgggccgttagttacgaaacccaaaccgtgaacgaaacgtacgacgaactaatttatgctaggcgtcgggtgacgaaggcgtaggttccacctatcctccgaggagatgtatcaagaagaacgacggtacgtacgtctgaacaaagtacgaaacacgaaccgtaacgaaaccgacggaaccgaccggaccgttgtactacgtggtcgaccgagtactacgttccgtacggttacgtttacgtttacgtttttacgtacgttcggtacccg

SEQ ID NO: 59973 - DNA, 735 bp, Homo sapiens
  misc_feature: GYAE6OF02IKA4N.26.57.F02.1.454.CMB.1.raw
  modified_base (627)..(627): a, c, t, g, unknown or other
  misc_feature (627)..(627): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggtttccttgttgcttattttaaaaggtgtccagtgtcaggtgcagctggtggaggtccgggggagcgttcggtccgacgggtcccggggggtccctgaaacctctcagtgtgcaggcctgtggattcgactattccgagtcgtacctcggtctaagtactaccggtcgggttaccccgccgtaggtccgtcgggaaccggggaaagggtccgtagggcggttcggtcgttcgggtacccgttaagttaaacgggaaaccctaaacccgtaggtaaccgtaaacggtaccgacgtaacttaaacgtttagacgtcgtcggtaccggtcgggtacgaccgtaagggtccgtaacggttccaaccctactccgtaaccgagtacgtagtacgtacctagaagtaaccggaacgtacggtacgttaacgtcgaacgtaacgaaacgtacgaacgacgtaaccgaacggaaaccggngaccgtaccgtcgttaagttacgttaccgtgtccgtaacaccgtaacttaccgtaccggttaacgtttcgttaaccgtttacgttttaccgtcgttaccggtaaccgg

SEQ ID NO: 59974 - DNA, 670 bp, Homo sapiens
  misc_feature: GYAE6OF02IWZL5.26.57.F02.1.454.CMB.1.raw
  modified_base (279)..(279): a, c, t, g, unknown or other
  misc_feature (279)..(279): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggaggtccgggggagcgttggtccgtaggccgggggggtccctgaactcgtcatcgtgcaggctctggattcgactnttcagtgacctcggctatatacgtcgggtccgccagttcgtggaccgggaaaggtcgagggacgtggacgttgggaccgttagttaacgaacctaaacgtcgacaaacgtaccgnaacgtatttacngtcgtgtccggtcggtagacgtaacggcgtagttaccaccgacgtctccgaagagtacgtcgtacttacgagaacgtaacgtacggcgttaagtcgtacggtaacgaaacgtacgaaactaacggtacccgtaacggaaaaccgggtaacgacggaaccgggtaccgttaacgtaacgttacgtacggtcgtaacccgagtaccgtaagtccgttaccgttacggttaccgtttaagtttttaccgtagttccgggtaaccccg

SEQ ID NO: 59975 - DNA, 553 bp, Homo sapiens
  misc_feature: GYAE6OF02HEFEN.26.57.F02.1.454.CMB.1.raw
  modified_base (285)..(285): a, c, t, g, unknown or other
  misc_feature (285)..(285): n is a, c, g, or t
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttcctgttgctatttaaaggtgtccagtgtcaggtgcagctggtggagtccgggggagcttggtccaggccgggggggtccctgaaactctcatgtgcaggctctggattcacattccagtgactcggntatatactgggtccgccagtctgccgggaaaggctggagtggcttggccgtattagaaccaaacctgacaagtacgagaactaatttangctgcgtggtgcaaggcaggttcaccatctacagagatgacttnaagtagaacgacggngtaactcgtagacaaatagaaacacgacctaagaaaaccgaggaaccacgggcgtagtacttagtagtcgaccgagacgacttccggtcgtacttacgttatttttcgaggttcgtaccg

SEQ ID NO: 59976 - DNA, 642 bp, Homo sapiens
  misc_feature: GYAE6OF02HK8T1.26.57.F02.1.454.CMB.1.raw
tcagagactatactcacgaccggtgctcgatttagctcgatatagttgggtttggggctgggagaggagctccagccttgggattcccagctgtctccactcggtgatcggcacctgaatacaagagactcaccatggagtttgggctgagctgggttttccttgttgctatttaaagtgtcagtgtcaggtgcagctggtggagtccggggagcgttggtccaggccgggggtacctgaaactctcagtgtgcaggctctggattcgacattcagtgactcggctatatacgtcgggtaccgccgagtcgtaggcccggggaaaggtcgtaggacgttggcgttggtccgttaattacggaacccaaacgtgaacgaacgtacgacgtactaactttatcgctagcgttcggagaccgaagggtctaggttaccaacctagttcctaccgtagtacgtagttacgtaacgttcgaacgtaagaaccgtaccgggtacgttacgtacctagacaaattacgaacgtacgaccgtaacggaaaaccgacggaccaacggtaccgtagtacgttacgtcgtagccgaacgtacctacgttccgtacgttacgttacgttaacttttacgtacgtacgttacccg

SEQ ID NO: 59977 - DNA, 589 bp, Homo sapiens
  misc_feature: GYAE6OF02IS1TF.26.57.F02.1.454.CMB.1.raw
  modified_base (386)..(386): a, c, t, g, unknown or other
  misc_feature (386)..(386): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggaggcttgggtccaggccgggggggtccctggaaactctcatgtgcaggctctggattcacattcagtgactcggctatatacgtgggtccgccagtctggaccgggaaaggcgtggagtggtcttggccgtattacgaaccaaactgaacaagtacgacgaacaatttangctgcgtcggtgacgagcgaggttacacatactcgagagtagtagtattcgaagacgaacgacggtctagtctagactaaagtagaaacgacgtacccgtaaggaaaccgacggacgaaccggtcgtagtacttacgtacgtacgacctaacgtacgtacgtaccgtagttacgttacgttagtttttcgtacggtcgtaccg

SEQ ID NO: 59978 - DNA, 929 bp, Homo sapiens
  misc_feature: GYAE6OF02HRSTM.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacaagagactcaccatggagtttggctgagctggtttccttgtgctagtttaaaggtgtcagtcgtcaggtgcgagtcgtggtggacggtccgggggaggtcgttcggtccgacgggtcccgggggggtccctaggaaaccgtcctaccacgttgtcgcgtacggtccttccgtaggtacttccgaaccgtacgtttccgaaggttcgaccgttcccgggacgttaagttaacgttaccggtacgggtccccgtacccgtacggttccgtacgggacccgggggtaaaaggtccggttgggaacggttcggggttccggtttacgggtacccgtttaaagttttaaacccgggaaaaccccgtaaaaccgtttacggaaaccccgttaaaacgggtaaccggtaccggtaaccgtttaaaagttttaacggcgtaccgtcggtcgggttccgggtacggaccgtaacggggtaccgtacgggttaccgtaacccgtacgttaccctacccgtaaaggtacgtaacgttacgtaacgtttacgaaggaacggtaaaccggaccggtaccggtaaccgttaccgtaacgaacgtaaacgtaaacggtaaccgaaccggtaccgtaaaccgggaaaacccgggtaacggtaaaccggaccgggttacccgggtttacggttaaccgtttaccggttaacggtcccggaaccggttaacggtaacctaccggtttaacccgggtttacccgtttaacggttttaccggttttacgtttttttaacccggtaccggtttacccggtttaacccggg

SEQ ID NO: 59979 - DNA, 532 bp, Homo sapiens
  misc_feature: GYAE6OF02FS0OK.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccagccgggggggtccctgaaactctcatgtgcaggctctggattcacattcagtgactcggctatatactgggtccgacagtctgccgggaaagggctggagtggcttggccgtattagaaccaaactgacaagtacgcgacaatttangctgcgtggtgcaagcagtcaccatctccagagatgatcagagaacacggacgtatctagacaaatagaacacgactacgaaaccgaggacacggccgtagtacttacgtgtcgccagactacgtaccgtcgtacttacgtatttttctagtgtaccg

SEQ ID NO: 59980 - DNA, 740 bp, Homo sapiens
  misc_feature: GYAE6OF02HYVXW.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggagcttggtccaggccgggggggtcctagaaactctcatgtgcgaggctctggattcaactattcaggtcgactcggactatatacgtcgggtccgacctagtcgtggaccgggggaaaggtccgtagggacgtgggtctttgggccgttaagttaacgaaacccaaaccgtggaacaaacggtaacgacgtaaactaaagtttacacggctcggtccgtgggtacgacgaagggtcgacggttaccacctactctaccgaggaagtagttagtacttacgaaggaaacggtaacgaaccgggtacgttaacgtacgtaccggtaacgtaaacgttacggaaaccgtaccgtaaccgtaaaccgggaaaaacccggtaacgggaaacccgaaccgggttaccggttaacggttaacgtttaccggtacggtacggaacccgtacggtaacccttaacgttacccggtttacgtttaacgttttaaccgtttaacgttttttaccgtaacggttccggttaacccgg

SEQ ID NO: 59981 - DNA, 676 bp, Homo sapiens
  misc_feature: GYAE6OF02HMFDJ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctattttaaaaggtgtccagtgtcaggtgcagctggtgggaggtccggggggaggtcttgggtccgagggccgggggggtccctagaaacctctcatgtgcaggctcgtggattcactattcagtgacgtcggctatattacgtcgggtcccgcccgtaggtccgtcgggaccggggaaaggggtccgtgggaaggtgggtccgtttgggaccgttaagttaacgaaaccctaaaccgtgaaccgaaagtaccgacgaactaaagtttatgctgcggtggtgacgaacggcgtacggttccacctatcctaccagagatgtatcgaagaacgaaccgacggtacgtataccgtagaactaaatacgaaccagtacccgtaacggaaaaccggaacggaaccgaaccggtacgttagttacttacggtcggtacaccgaacgtaaccgtacgttacccggttattaacgtttaccgttttaactttttcggtacggttccggtaacccg

SEQ ID NO: 59982 - DNA, 929 bp, Homo sapiens
  misc_feature: GYAE6OF02HW31X.26.57.F02.1.454.CMB.1.raw
  modified_base (258)..(258): a, c, t, g, unknown or other
  misc_feature (258)..(258): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccgggggagcttggtccgagggccggggggtcctgaactctcagtgngcgaggtctcgtggacttcactattcgagtgacgtcggcttattacgtacgtcggggtcccaccgtagttccgtacggggaccggggaaaggggtcgttacgggaggttcgggtaccggttcgggtccgttaacgttaaacggaaaacccctaaccgttacgaaccgtaaacggtaccggacgtaaacttaaagttttacgtacggacgttacggcggttacgggtacgaacgggtaacgggacgttacgggtttaccctaacccgtaccgttacccgtaccgtaacggtaagttaacgttacgttaaacggttaaccgtaaacgggtaaaccggtaaacccgggtaacccggggtaccgtttaaacgtaccggtaaccggtaaaccgtaaaacggtaaccggtaaaaccgtaacccgggtaacccggttaaaaaccggggaaaaaccccgggtaaaccggggtaaacccggtaaaccccgggggtttacccggtttaaaccgggtttaaccgtttttacccgggtaccgggttaacccggtaacccggtaaccggtaaacccggttacccgtttaaccccggtttttaaccggtttaaacggttttttaacccggtttttaacccggtttttttaaccgttacgggggttttacccccggttaacccggg

SEQ ID NO: 59983 - DNA, 708 bp, Homo sapiens
  misc_feature: GYAE6OF02GV6LY.26.57.F02.1.454.CMB.1.raw
  modified_base (146)..(146): a, c, t, g, unknown or other
  misc_feature (146)..(146): n is a, c, g, or t
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
tcagagactatactcacgaccggtgctcgatttagctcgatatagttgggtttgggggttgttcctgggagatgctgataccacgacacataattcttccccaatattggagctgctccctcctcctcctcctacctctccattcnctgcacaggccgtggccagtctgtctgtcncanccgccctcactatctncggcccgacgacgagaggtcaccactctcctcgctacgtgaagcagcaccatattggaagtaattatcgtgtcgtcgtaagtgagccatctacccgaacggacaccaccccaaacctcctctacgtacttaagtataaaaagtactacggtaccggtacccctacgcggtacctattacccggttcgtaccccgtaatttccacgtttggtaccccttcgtaaaccggtggtttacccggctaccggtaccgtacccgacccgtaacccgtcggggaactccgtacgacggtaccgtaccgtacctacggtacgggacgggaccggtaaccggccttaaacgtttagtaccgtacgaccgggtaactaccgtggggaacgttcgaactacgggttaccctagggtacgtccgggtccggtttacgggggtttccgggtcggggaaccggtaccgacgtaacccggttcggaacccgttcccgtaaggttcccacggtcccgaacggtccccgg

SEQ ID NO: 59984 - DNA, 702 bp, Homo sapiens
  misc_feature: GYAE6OF02JNG5K.26.57.F02.1.454.CMB.1.raw
  modified_base (134)..(134): a, c, t, g, unknown or other
  misc_feature (134)..(134): n is a, c, g, or t
  modified_base (154)..(154): a, c, t, g, unknown or other
  misc_feature (154)..(154): n is a, c, g, or t
  modified_base (198)..(198): a, c, t, g, unknown or other
  misc_feature (198)..(198): n is a, c, g, or t
tcagagactatactcacgaccggtgctcgatttagctcgatatagttgggtttggggtcgtggggagagggagctccagccttgggattcccagctgtctccactcggtgatcggcactgaatacaagagattnaccatggagttgggctgagngtggtttcctgtggctatttaaaggtgtccagtgtcaggtgacngctggtggagtccgggggagcgttggccaggccggggggtcccagtaaaccgtctcatgtagcgagtctctcggattcgactattcagtgtacgtcggactatactacgtcggtaccgtcaacgtcgtacggaccggggaaaggccggtggagtcggcgttcggaccggttacgttaaacgaaccgtaaaaccgtgaaaccgtaacggtaaaccggcgtaaacgtaaatttacgagtacccgttgcggtttcggagtacccgtaaggtccgtagggtaccctaaccacttaccggtaccgacgtaaggtactacgtaattaccgaagtaacggaacccgtaggtaccgtaaagttcgaggtaaccaaagtaaccgaccgaggtaaccgtaacgaaaccggtaacgtaacggaacgtccggtagttaaccgttctacgggactaccgaagaccgtacgtaccgtacgttacgttaccgttacttttcgtaccggttagtacccgg

SEQ ID NO: 59985 - DNA, 604 bp, Homo sapiens
  misc_feature: GYAE6OF02HB7Y7.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccaggccggggggtccctgaaactctcatgtgcgaggctcgtggattcacgtattcgagtgactcggctatagtacgtgggtcccgccgtagtcctcggccggggaaaggcgtgggagtggcttggccgtattacgaaccaaaccgtgaacaagtacgacgaactaattagtgctgccgtcggtgacgaaggcgtaggtccactactctccgagacgagtgagtacgaagaacgaaccgacggacgtacgtcgtagacgtaaagtacgaacgacgaccgtaacgaaaccgaggaccgacggcgttagtacgtcgtagtcgaccgacgacgtacgtccgtacgttacgtttaccgttattttacgtagttcgtaccgg

SEQ ID NO: 59986 - DNA, 790 bp, Homo sapiens
  misc_feature: GYAE6OF02G5FIG.26.57.F02.1.454.CMB.1.raw
  modified_base (178)..(178): a, c, t, g, unknown or other
  misc_feature (178)..(178): n is a, c, g, or t
tcagagactatactcacgaccggtgctcgatttagctcgatatagttgggtttggggctgggagaggagctccagccttgggattccccagctgtctccactcggtgatcggcactgaatacaagagactcaccatggagtttggctgagctgggttttcctgttgctatttaaaggngtccagtgtcagtgcagctggtggagtccgggggagcttggtccaggcccgggggggtccctggaaacctctcatggtgcgaggctcgtggattcacattcagtgaactggactatatacgtggtcccgcagtcaggtaccgggaaaggcgtaggagtggacgttggaccgttaataacgaaaccaaaccgttagaacgaaaggtaccaccggtaaactaaatttagcgtaccgtaggccgtacgggtacgaccgaacgggtactaacggggttaccaaaccgtactacccgtacccgaagtaacgtaattccggtaattacgaaacggtaaacggtaaaccggtaaccggaaccgtttaacgtaccgttaacggtaaacgttaaaaacgttacggaaaacccgtaaccgtaacccggttaaaccgggaaaaaacccggtacgggttaaaccggaacccgggttacccgggttaaagttaccgtttaaccgttagggtaaccgtaacccggtaaacggtaacccgtaaccgtttcccggtaaccggttttaacgtttaaacccgggttttaacgttttttaacccggtacgggtttacccggttaaccccgg

SEQ ID NO: 59987 - DNA, 775 bp, Homo sapiens
  misc_feature: GYAE6OF02G9G65.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggaggtccggggggagtcggtcggtcgacggggtcccggggtccgtacgaactctacagtggtgcgacgtcgttcggtaggtacttaccacgttcgttacgtaggtacgtaccgtcggtacttaattacgtacgggtccgggtcccgtcgtacggttccggtaccggggaaccgggggtaacggtcggtagggtaggtcgggttcggttacgggtaccttaacggtaaccgaaacctaacgtacgaacgtaacgtacgaacgtaactttaaagttctacgtcgtcggtcggtacgggacgacggacggtcgttacgtaccaacgtctaccctggaacgagtacgtactacgtacgaagtaacggaaccgtacggtcttaacgtcgaacgtaacgaaacggtaacaacccggtacggtaaccgaaaacccgggaaacgggccggtaaacccggtccgggttaacgtttaacgtttacgttacccggtggtaaccaccggtaacgtaacccgttccgttacgttaacgttaacggtttacgtttttacccggtttagtaccggtccggttaaccg

SEQ ID NO: 59988 - DNA, 801 bp, Homo sapiens
  misc_feature: GYAE6OF02JTL0Z.26.57.F02.1.454.CMB.1.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
tcagagactatactcacgaccggtgctcgatttagctcgatatagttgggtttggggtcgtgggaggaggaggctccagccttgggattcccagctgtctccactcggtgatcggcactgaatacaagagactcaccatggagttgggctgagctgggttttcctgttgtctattttaaaggtgtccagtgtcaggtgcagctggtggaggtccgggggaggtcgttggtccgaggcccgggggggtccctggaactcncgatgtgcgaggctntcggattcactattcagtcgactcggactatagtacgtgggtcccgccgtacgtcgtacgggaccggggaaagggtccgtggggacggttcggcgtttcgggtacccgttaggtttaaccgaaacccgtaaaaccgtacggtaaaccgtaaacgggttaccggaacggtaaacccgttaaagtttttaaacggtcggttacccggttaacggttaccggggttcccgggttaaggtacccggtaaaagggcccggttaacgggttacccgtaaccgtacgtttaccgtaccgtaacggtacgagttacgtaacgttacgtaaggaacgaaccgtaccggtacgttacgtacgtcgtaacgtaaacgtacgtaaaccgtacgtaacccggtaacgaaaacccgggtacggaaaccgaccgggtccgtaagttaccggttacgtacggtaccgtacgaaccgaaccgtaccgttaccggttacgtttacgttaaccgtttagtttttaacgcggtttaccgttacccgg

SEQ ID NO: 59989 - DNA, 568 bp, Homo sapiens
  misc_feature: GYAE6OF02JGRP2.26.57.F02.1.454.CMB.1.raw
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgttgctatttaaaggtgtccagtgtcaggtgcagctggtggagtccgggggaggcttggtccaggccggggggtcctggaaactctcatgtgcaggctctggattcacattcagtgactcggatatatacgtcgggtccgccagtctggaccgggaaagggctggagtggcgttggccgttatacgaacctaactgacaagtacgacgactaattangctgcgtcggtgcaggctagtcactanctacgagagtatgattacagacgacgacggtcgtatactgactaatagaacgacgacgtaacgaaaccgagaacgacggtcgtagttacgttcgtacgtcgaccgaagtaactacgtaccgtacgttaacgttacgttacgttttcgtacggttccgtaaccgg

SEQ ID NO: 59990 - DNA, 793 bp, Homo sapiens
  misc_feature: GYAE6OF02INT9F.26.57.F02.1.454.CMB.1.raw
  modified_base (193)..(193): a, c, t, g, unknown or other
  misc_feature (193)..(193): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaagtgtcagtgtcaggtncagctggtggaggtccgggggaggcgttgggtccacggccgggggggtcctaggaaaactctacatggtgcgaggctcgtggtattcacgtacttcgaagtgaccgtcggacttaagtactacgttcgggtacccgcctaacggttcgttacggaacccgggggaaagggccgtagggtacggtagggtccgttttcgggaccgttaaacgtttaacggaaaaccctaaaccgtagaaccgtaaacggttaaccgggaacgtaaacccgtaaagttttacgtaacggtccgttaggtccggttacgggtcgtaaccgtaaagggggcccgtaacggttaccctaacccgtaagttccccgtaaccggaagtaacggtaacgtaaggtaacggttaccgaaacggaaacggtaaaccgtaaccgggttaccgttacttaaccggtaccgaaacgtaaagtacggaaaccgtaaccgaccgtaaacggaaaaaccggtacggaaaccgacggtaccgttaagttacgtacgttaggtcgacctaggaaccgtactacggttacgttcgttaaccgttattttaccgtagttccgtaacccgg

SEQ ID NO: 59991 - DNA, 598 bp, Homo sapiens
  misc_feature: GYAE6OF02GHQ8A.26.57.F02.1.454.CMB.1.raw
  modified_base (304)..(304): a, c, t, g, unknown or other
  misc_feature (304)..(304): n is a, c, g, or t
  modified_base (381)..(381): a, c, t, g, unknown or other
  misc_feature (381)..(381): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggcccggggggtccctgaaactctcatgtgcaggctctggattcacgattcagtgactcggctatatactgggtccncagtctggccgggaagggctggagtggcttggccgtatacgaaccaaaccttgaacaagtacgacgaactaatttangactgcggtcggtgacgaaggcgaggttcacatctacagagatgattcgagacgacgacgcgtatctagacaaagtagaaccgacgaccgtaacgaaaccgacggaaccgaccgggaccgtagttacgttacgttacggtcgaccgacgtaaccgtacgttcccggttacggttaacgtttaccggttacttttttacgtacggttcgttaccccgg

SEQ ID NO: 59992 - DNA, 625 bp, Homo sapiens
  misc_feature: GYAE6OF02FPQ3E.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaaggtgtccagtgtcaggtgcagctggtggaggtccgggggaggcttggtccgaggccgggggggtccctgaaactcgtcagtgtgcgaggctctggattccacgattcaagtgactcggctatatactgggtccgccagtctggccggaaaggctggacgtggcttggccgtattagaaccaaacctgaacaagtacgacgaactaaatttatgctcgtcggtcggtgaccgtaaggcgtacgggttcaccaacgtcctaccgagagatacgtaagttacgaagtaagaacgacggcgtaagtctacgacaaagtagaacgacgaccgtaacgaaaccgaacggacgaaccggtaccgtagtactacgtcggttacgacccgtacgacctacgttaccgttacgttaacgtttaacgttacgttttttacttacgggtcggttaacccg

SEQ ID NO: 59993 - DNA, 616 bp, Homo sapiens
  misc_feature: GYAE6OF02H4YA2.26.57.F02.1.454.CMB.1.raw
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttcctgttgctatttaaagtgtccagtgtcaggtgcagctggtggagtccgggggagcttggtccaggccggggggtccctgaactctcatgtgcaggctctggattcgactattcgagtcgtactcggtctattatacgtcggtacccgcctaggtcgtcggaccgggaaagggctagggagtcggcttggtaccgtattaacgaaccaacgtgaacaagtacgcgaatattagngtctgtcgtggngacacggctaggtaccacgtactcgtacagacgtatcgattacgacgaagaacgacggtacgtagtctacgtactaaacgtacgaacgacgtacgtaacgtaaaccgacggaccgacggtaccgttagttacgtaacgttggcgaccgaacgtaccgtaccgttaccgttacgttaacgtttacgtttactttttacgtacgttcgtaacccg

SEQ ID NO: 59994 - DNA, 536 bp, Homo sapiens
  misc_feature: GYAE6OF02GEWHD.26.57.F02.1.454.CMB.1.raw
  modified_base (378)..(378): a, c, t, g, unknown or other
  misc_feature (378)..(378): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctagtatactgggtccgccagtctgccgggaaagggctggagtggcttggccgtattagaaccaaacctgaacaagtacgcgacaatttangctgcgtcggtgcaaggcaggttcaccatctccagagatgattcagagaacacggcgtatctgacaaatgaacagcctagaaaaccgaggaacacggccgtgtattactggtgccagacactaccgtcgttacgttacgtatttttcagttgtacccg

SEQ ID NO: 59995 - DNA, 842 bp, Homo sapiens
  misc_feature: GYAE6OF02FFNJY.26.57.F02.1.454.CMB.1.raw
tcagagactatactcacgaccggtgctcgatttagctcgatatagttgggtttgggctgggagaggagctccagccttgggattcccagctgtctccactcggtgatcggcactgaatacagagactcaccagtggagttggctgagtcttgggttttccttgtgtacttaagtttaaaggtgtccagtcgtcgaggtgcgagtcgtggtggacggtccggggagtcgttcggccgtacgggtccgggggtcctagtaacgtctcgagtgcgtccgtacggtcgttcgtacggtacttacgactagttacgacggttcgtacgttacggtacttaacgttacgttacgtaccgggtacccgtacctacggtccggtacgggaccgggaaacgggtcggtacggttacggtcggttcgttaacccgggtaccgttaaaccgttaaaccgaaacccgtaaccgtaccggaaacgttaaccggtaccgaccttaaacgtaacgtttacggtccgtaccggtcggtaccggttacggtacggtacgtaacggtccgtaacggttacccaacgttccgtacccgtacgtaagtaacgtacgtacgtaacgtaacggacggtaaccgaacccgtacggtaccttaacgtaccgtaaccgtaaagtacccggaagtaaacccgtaccggttaaacccgaaaccgggttaaaccgggaccgtaaccggtacccgttaacggttagttaccgtacgtcggtaacccgacgtaacccggtacgtttacccggtaccgttttaacgttaaccgtttaccgtttcgttttaaccggccggtttacgtaacccgg

SEQ ID NO: 59996 - DNA, 554 bp, Homo sapiens
  misc_feature: GYAE6OF02FQELH.26.57.F02.1.454.CMB.1.raw
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagctggtccaggccgggggggtcctgaaactctcatgtgcaggctctggattcacattcagtgactcggctatatactgggtcccnccagtctgaccgggaaagggctagggagtggcttggcctagtagaaccaaactgacagtacgacgactaatttangctgcgtcggtgcaaggcaggttcacatcacagagatgatacagagacgacggcgtatcgtgtacaatagaacacgacctaacggaaaccgagaccgacggacgtagtacgtactaggtcgacctagacctagtccgtacgttacttaccggttacttttcgtaggttcgtacccg

SEQ ID NO: 59997 - DNA, 739 bp, Homo sapiens
  misc_feature: GYAE6OF02JRGNS.26.57.F02.1.454.CMB.1.raw
  modified_base (434)..(434): a, c, t, g, unknown or other
  misc_feature (434)..(434): n is a, c, g, or t
tcagagactatactcacgaccggtgctcgatttagctcgatatagttgggtttggggcgtgggagaggagctccagccttgggattcccagcctgtctccactcggtgatcggcactgaatacaagagactcaccatggagtttggctgagctgggtttcctgttgctattttaaaggtgtccagtgtcgaggtgcagctggtggtaggtccgggggaggtcgttggtccagggcccggggggggtccctaggaaaccgtctcgatcgtgccgaggctcgtaggtacttcacattcgagtcgacgtcggactatactacgtcgggtcccgtccagttcgcggacccgggaaggggcctagggagtcggccgtttgggccgttaagttaacggaaacccaaccgtacgaacaacggtacgacgtaactaatttangtacgtggccggttcggtacgcgtaaacgggtcgtacggttaccgaacctacttcgtaccgaggaacgtagttacaacgttaccgaaggtaacgaaaccgaccggggttacctaattcccgtagaactaaaacgttacggaaaacgtaccggtaccctaaacgggaaaaaccccggttaggaaacccggtaccggaccgtttaacgtacgttaaccgtaggttcccggaaactacgggaacctacgttaccgttacggtttaacttaacccgttttacgtttttacgacggttaaccgggttccc

SEQ ID NO: 59998 - DNA, 864 bp, Homo sapiens
  misc_feature: GYAE6OF02J1X3R.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcgaggtgcagctggtggaggtccgggggaggtcgttcggtccgaggtccgggggggtccctaggaaactctcatgtgcaggcctctggtattacactattcaggttcgacgtcggtactagttacgttaacgtcggggttacccgccgtaggttccgtacgggtaacccgggggtaaaggggtccgttaggggaacgggttccggggttaccgttttaccggggtcccggtttaaaacggtttaaacccggaaaaccccgtaaaacccggttaacggtaaccggttaaaaccggtaaccggtaaccggtaaccctttaaagttttaaacgtcggtaaccgtcgggtaccggttaccgggtcggaaccgtaaacgggtccgtaaacggggtttccctaaaccccgtacgttaccccgtaccggtaaacggtaaagttacgttaacgtactttaacgaaacggtaacgaaccggtaccggtacgtacgtccgagtaacgaaagttacgaaaccgtacgtaccgtaaaccggaaaccgtacggaaaccgtaccggtaccgtttagttaccgtacggttcggtaaccggtaccgtaagtaaccctcggtttaacccggttaccggtttaagtttaacccgttttaccggttttaacgtccgggttaccggttaacccgg

SEQ ID NO: 59999 - DNA, 729 bp, Homo sapiens
  misc_feature: GYAE6OF02IWEIW.26.57.F02.1.454.CMB.1.raw
  modified_base (169)..(169): a, c, t, g, unknown or other
  misc_feature (169)..(169): n is a, c, g, or t
  modified_base (185)..(185): a, c, t, g, unknown or other
  misc_feature (185)..(185): n is a, c, g, or t
  modified_base (665)..(665): a, c, t, g, unknown or other
  misc_feature (665)..(665): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgnttaattttaaaaggtntccagtgtcaggtgcagcgtggtggaggtccgggggaggcgtttggtccgagggcccgggggggtccctaggaaacctctacattggtgcgaggtctcgtggtatttcgactattcgagtcgtactcggactatacgtacgttcgggtcccgccgtagttcgtacgggaccggggaaagggcgtagggaggttcgggtcggtttcgggaccgttaagtttaacgaaaacccgtaaacctaggaaaccgtaaaggtaaccgtacgaacgttaaaattttagttacgtgtcgtaccggtcgggtacggtcgaaacggtacgtacggttaccgtaaccacttccgtacgaaggtaacgtacgtacgtacgttacgaacgtaagaaccgacgtacggttcgtaacgtacgaaactaagtaacgaacgaacaccgtaacgaaaccgtaacggaacgaccggtacgtacgttactacgttggtacnccgaaacgactacgtacgttaccgttaagtttaccgtttattttacggtacgttacgttaccgg

SEQ ID NO: 60000 - DNA, 667 bp, Homo sapiens
  misc_feature: GYAE6OF02GROUU.26.57.F02.1.454.CMB.1.raw
  modified_base (297)..(297): a, c, t, g, unknown or other
  misc_feature (297)..(297): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctggtggaggtccgggggaggcttggtccgaggcccgggggggtccctagaaacctctcatgtgcaggctctggattcactattcagtgactcggntatatacgtcgggtcccgcgagtctcggaccggggaaaggcgtggaggtcggtcgttcggtccgtagttaacgaaaaccctaaaccgtgaaacgaaacggtacgcgtaaacttaatttaagtcgtactggtcggtcgggtgacgaacggcgtacggttccacctactctacgaagtagtacgtgtacgttacgaagaacgaaccgacggtacgtaatcgtagaacgtaaagtacgaaacgacgtaccgaacggaaaccggacggaccgaccggtccgtagttacgttacgtggtcgaccgtaacgaccgtacgttcccgtttaacgttacgtttacgtttactttttacgtacggttaccggttacccgg

SEQ ID NO: 60001 - DNA, 835 bp, Homo sapiens
  misc_feature: GYAE6OF02IA2QR.26.57.F02.1.454.CMB.1.raw
  modified_base (442)..(442): a, c, t, g, unknown or other
  misc_feature (442)..(442): n is a, c, g, or t
tcagagactatactcacgaccggtgctcgatttagctcgatatagttgggtttgggggctgggagaggagctccagccttgggattcccgagctgtacctccactcggtgatcggcactgaatacaagagactcaccatggagtttgggctgagctgggttttccttgttgcttaattttaaaaggtcgtccagtgtcaggtgcagctggtggaggtccgggggaggcgttgggtccgacgggccgggggggtccctggaaactctcatgtcgcacggtctcgtggattcgaactattcgagtcgactcggactatagtacgtgggtccccacgagtccgtggacccggggaaaggccgtagggtagtcgggtcttgggaccgtttaagttaacgaaacctaaaaccgtagaaccaagtacgacgtaaactaaacgttttangtactgacggttcggtgacgtaaacgggtcgtacgggttaccaaccctaacgttaccctacccgtaaaggtacgtaacgttacgtaacgtttaacgaaacggaaacgtaaaaccgaacccggggttaccgttaacgttaccgtaacggtaaaccgtaaaaacgttaacggtaaacccgtaacgggtaccccgtaaaaaccggggaaaaacccgggtaaccgggaaaacccggtacccgggggttaacccgtttaacgggttaaccgtttaaccggttacgggtcggtaacccgtaacgaacccggttaaacccgtttccgggttaaccgtttaacggtttaaccggtttttaaacgtttttttccgttaacgggtttacccggttaaccccgg

SEQ ID NO: 60002 - DNA, 659 bp, Homo sapiens
  misc_feature: GYAE6OF02F8MNQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagttgggctgagctgggttttccttgttgctattttaaaaggtgtccagtgtcaggtgcagctggtggagtccgggggaggcttggtccaggccgggggggtccctggaaacctctcatgtgcgaggctcgtggattcacattcagtgactcggctatactacgtgggtcccgccagtctggccgggaaagggcgtggagtgggcttgggccgtatacgaacctaaacctgaacaagtaccgcgaactaatttatgctagcgtcggtgacgaagggtcgacggttccaacctatacctaccgagaacgtagtacggtaacttccgaaggaacgaaccgacgggacgttataccgtagaactaaatacgaaacgacgtaccgtaacgaaaaccggaacggaaccgaaccgggtaccgttacggttacttaccgtaggtaccggacccgtaacggtaacctacgtacccggttacgttacgtttaaccggtttattttttaccgtacggttaccggttacccgg

SEQ ID NO: 60003 - DNA, 772 bp, Homo sapiens
  misc_feature: GYAE6OF02IS9QL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagacgactcacccatggagtttgggctgagcgttgggtttccttgtgcttaagttttaaaggtgtccagtgtcgaggtgcagtctggtggacggtccgggggaggtcttggtccgacgggtccggggggtccctaggaaactcgtcagtgtgcgacggctcgtggattcaactattccaggtcgaccgtcggtactataactacgttcggggtccccgtccgaggttccgtcggggaaccggggtaaaggggcgttagggaggttggtccggttggtacccgtttaagtaaccgtaaaaccctaaaccgtcggtaaacgaaaggtaaccgaaccggtaaacttaaattttaacgtggtcctaggtccgggttaccggtgaaccgaacgggtaccgtacgggttccctaaaccgtctaaccctcccggaacgtaggacttaggtaacgttacgaaggtaacgtaaacgacgggttacgtaacttacgtacgaacaaagtaacgaaacgtaccgaacctaaacggaaaacccggacggtaaccgaaccggtacgttacgtacgttaccggtaggtgaacccgtaagtaaccgtacgtaccgttaacgttactttacggtttaaccttttcggttacgttaccggtaacccgg

SEQ ID NO: 60004 - DNA, 706 bp, Homo sapiens
  misc_feature: GYAE6OF02ISJYB.26.57.F02.1.454.CMB.1.raw
  modified_base (185)..(185): a, c, t, g, unknown or other
  misc_feature (185)..(185): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtntccagtgtcaggtgcagctggtggaggtccgggggagtcgttggtccgagggcccgggggggtccctaggaaccgtctcatgtgcgaggcttcgtggtacttcacgtattcagtgaccgtcggactatattacgtcgggtcccgcgacgttccgtgggacccggggaaagggtcgtggaggtcggtcgttggccgttagttaacaaacctactacgaactaacgtacgacgtaactaattagtgtctcggcgttggcgcgtaaacgggtcgtaacggtttccgaaccacgttccgtacgtaaccggtagtacggtataacgttacgaaggtaacgaaaccgaccggttacggttaccgtacgtacgaactaaacgttaggaaacgtaccgtaaccgtaacggaaaacccgaggaccgaaccgggtaccgtacgttactaccgttcggtcgaacccgtaggtaacctacgttaccggtacgttacgtttaccgttacgttttaccgtggttaccggttaccg

SEQ ID NO: 60005 - DNA, 749 bp, Homo sapiens
  misc_feature: GYAE6OF02HJ9U0.26.57.F02.1.454.CMB.1.raw
  modified_base (319)..(319): a, c, t, g, unknown or other
  misc_feature (319)..(319): n is a, c, g, or t
tcagagactatactcacgaccggtgctcgatttagctcgatatagttgggtttggggctgggagaggagctccagccttgggattcccagctgtctccactcggtgatcggcactgaatacaagagacctcaccatggagtttgggctgagcttgggttttccttgttgctattttaaaaggtgtccagtgtcaggtgcagctggtggaggtccgggggaggcgttggtccagggccggggggtccctgaaactctcatgtgcaggctcgtggattccactattcagtcgactcggacctatactacgtcggggtcccnccgagttccgtcggaccggggaaaacgggtctgggagtcgggtcgttcgggacccgttaagttaacggaaaaccccgtaaaccgtgaaaccgaaacgtaacggaccggtaactaaaagtttttagacgtcgtacggtccgggttcgggtacggaaccgtaagggacgtaacggtttaccgaaccctaacgttccgtaacccgaagaacggtaagtacggtaattacgaaggaaacgtaaaccggtaaccgggtacgttaaacgtcgtaacgaacgtaaaagtacggaaaccgaacgtacccggtaaacgaaaacccgggtaaggaaacgaccgggtaaccgtagttacgttacgtcgttacgaccgtacgacgtaccgttaccgttacgttaacttacgtttaattttaccggtacgtttcgtaacccgg

SEQ ID NO: 60006 - DNA, 583 bp, Homo sapiens
  misc_feature: GYAE6OF02HIU48.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccgccagtctggccgggaaggctggagtggcttggccgtattagaaccaaacctgacaagtacgcgactaatttatgctagcgtcggtgcgaaggcaggttcaacctatctaccagacgatgattcgaagaagaacgacggacgtatactgacaaatagaacgacgaccgtaacgaaaaccgacggaaccgaaccgggaccgttagttacttacgtgtacgccacgtacgtacgtaccgttacgttacgttacgttacgttttttacgtagttcggttacccg

SEQ ID NO: 60007 - DNA, 706 bp, Homo sapiens
  misc_feature: GYAE6OF02IERSR.26.57.F02.1.454.CMB.1.raw
  modified_base (422)..(422): a, c, t, g, unknown or other
  misc_feature (422)..(422): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttcttgttgctattttaaaaggtgtccagtgtcaggtgcagctggtgggagtccgggggaggcttggtccaggccggggggtccctgaaactctcatgtgcaggctcgtggtacttcacgtattcgagtgacgtcggacttaatagttaacgtgggtcccgccgtagtccgtacggaccggggaaaggcgtgggaggtggcgttggaccgttagttaacgaaacctaaaccgagaactaaaggtaccgacgtaactaaattttagngtctgtcgtcggtcgacgaagggtcgtacggttccaaccgtactacctacccgaaggacgtaagtagtaacgttacaacggtaaacggaaaccgaaccggtacgttaacttacgtacgaactaaaagttaacgaaccgaacgtaccgtaacggaaaaacccgaacggaaaccggaccggtaccgttagtacgttacgtacggtcgtaccgaacgtaccgtacgtttaccggttacgttacggtttaaccgtttacgttttttacgtacggttacggttaccccg

SEQ ID NO: 60008 - DNA, 574 bp, Homo sapiens
  misc_feature: GYAE6OF02FSTPQ.26.57.F02.1.454.CMB.1.raw
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggagtttgggctgagctgggttttccttgttgctattttaaaaggtgtccagtgtcaggtgcagctggtggaggtccgggggaggcgtttggtccgaggccgggggggtccctgaaactctcatgtgcaggctctggattcacattcagtgactcggctatatacgtgggtccgccagtctggccgggaaaggcgtggagtggcttgggccgtattacgaaccaacctgaacagtacgcgacaatttangctgcgtcggtgcaaggctaggtcaccatctcagngatgtatcagagaacgacggactatcgtcacaaatacgaacagaccgtacgaaaccgagaccgacggtaccgtagtacttacgtggtcgaccgtagaacctacgttcccgtacgtttactttaacgtttacgttttttctaggttccggtacccg

SEQ ID NO: 60009 - DNA, 656 bp, Homo sapiens
  misc_feature: GYAE6OF02F75T7.26.57.F02.1.454.CMB.1.raw
  modified_base (401)..(401): a, c, t, g, unknown or other
  misc_feature (401)..(401): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccagggcccgggggggtcctgaaactctcatgtgcgaggctcgtggattcacattcgagtgactcggctatatacgtgggtccgccagtcgtcggaccgggaaggcgtgggagtggcgttgggaccgttattaacgaaccaaaccgtgaacgaacgtacgacgactaagtttangtcgtgcgttcggtagcgaaggcgtacgttacaccgtactccgtacagacgtagtagtactacgagaacgaaccgaacggtacgtactacgtagaactaaagtacgaacacgaccgtaacggaaacgaacggaaccgtaccggtacgttacgttaacgttacgtacggtaacgaccgaacgtaaccgtacgttaccggttacgttaacgtttaaccggtttaactttttaccggtacggttaccggttaacccgg

SEQ ID NO: 60010 - DNA, 664 bp, Homo sapiens
  misc_feature: GYAE6OF02JA5WY.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgtgctattttaaaaggtgtccagtgtcaggtgcagctggtggaggtccgggggaggcttggtccaggccgggggggtcctgaaactctcatgtgcaggctctggattcacattcacgtgacctcggctatactactcgggtccgcctagtcgtcggccggggaaagggcgtgggagtgggtcttgggaccgttattaacggaaccgtaaacctgaacctaaaggttacgacggaacctaagttttatcgtacttggtccggtcgggtcgacgaaggtccgtagggttccacccgtactccgtacccgaagagattgacttacaacggtaagaaccgacggtacgtactacgtagtaacgtaaactagaacgtacgaccgtaacgtaaaacccgaacggaaaccggacgggtaccgttagtacgtttacgtaggtcggacctacgaactacgtcccggttacgttacgttaaccgtttactttttactacggttcgttacccg

SEQ ID NO: 60011 - DNA, 605 bp, Homo sapiens
  misc_feature: GYAE6OF02IT3YI.26.57.F02.1.454.CMB.1.raw
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttgggtccaggcccgggggggtccctgaaactctcatgtgcaggctcgtggattcacattcagtgacgtcggctatatacgtcgggtcccgccaggtcgtacggccggggaaagggctgggagtggcgttggccgttattacgaaaccaacgtcgaacaagtacgcgaactaatttangctgcgttcggngcgaaggcaggtcaccatctccagagatgatcgagagaacgacgcgtatctagacaaagtagaacgacgacctaacggaaaaccgacggaacgaccggaccgttacgtacgttacgtacggtcgaccgacgtaccgtaccgttaccgttacgttacgtttacgttactttttaccgtacggttcggttacccg

SEQ ID NO: 60012 - DNA, 598 bp, Homo sapiens
  misc_feature: GYAE6OF02FZZI9.26.57.F02.1.454.CMB.1.raw
  modified_base (401)..(401): a, c, t, g, unknown or other
  misc_feature (401)..(401): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcgttggtccaggccggggggtcctgaaactctcatgtgcgaggctcgtggattcactattcagtgactcggctatatacgtgggtccgccgagtcgtaggcccgggaaagggcctgggagtcggcgttggccgtaagttacgaaaccctaaacgtgaactaagtaccgacgaactaagtttangacgtagcgtcggtgactaaggcgtacggttcgaccgatccgtacagagagtcgtatacgagacgaacgacggtcgtatcgtgaacaatacgaacgagaccgagaaaccgagaccgacggaccgtagttactacgtcgtcgaccgacgactacgtaccggtacttacgttacgttattttcgtacgttcggtaccgg

SEQ ID NO: 60013 - DNA, 793 bp, Homo sapiens
  misc_feature: GYAE6OF02HCLLO.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttggtccgagggccgggggggtccctagaaactctcatgtgcaggctcgtggtattcacgtattcgagttcgacgtcggctactagtacgtcgggtacccgccgtaggttccgtacgggacccgggggaaagggtccgttaggggaacggttggggtccgtttcggggtacccgtttaagttaacggaaaaccccgtaaaccgttacggaaaccgtaaacgggttaccggaacggtaaaccttaaacgtttttaacgtcggtacttacgggtccgggtttacgggtccggtaaccggaacgggtaccgttaacggggttacccaacccgttacgttaccctacccgaaggtaacggtacgttaggtacgtttacgaacggtaacggaaaccggtaaccggtacggttacgtaccgtagaacgtaaacgtacgaaacgaccgaaccgtaacggaaaccggaacggaccgaacgggtaccgtagttacgttaacgtcgtacggacctacggaacgtaccgttccggtactttaacgttaccgtttacgttttacgtacggttcgttacccgg

SEQ ID NO: 60014 - DNA, 601 bp, Homo sapiens
  misc_feature: GYAE6OF02FNPJT.26.57.F02.1.454.CMB.1.raw
  modified_base (310)..(310): a, c, t, g, unknown or other
  misc_feature (310)..(310): n is a, c, g, or t
  modified_base (401)..(401): a, c, t, g, unknown or other
  misc_feature (401)..(401): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcgttggtccaggccgggggggtccctgaacctctcatgtgcaggctctggattcactattcagtcgactcggctatatacgtgggtcccncagtcgtcggaccgggaagggcgtaggaggtggcgttggtcgtagttacgaacctaaaccgtgaacgtaacgtacgacgtaactaatttangtacgtgtcggtcgggtgaccgaaggtcgacggttacaccgtatcctacagagtatgactacgagacgaacgacggcgtactctagactaatagaacacgaccgtaacgaaaccggacggacgacggtaccgtagttactacgtgtcgaccagtaacctcgtccgtacgttactttacgttattttcgtacgtcgtaccg

SEQ ID NO: 60015 - DNA, 640 bp, Homo sapiens
  misc_feature: GYAE6OF02H5XO0.26.57.F02.1.454.CMB.1.raw
  modified_base (280)..(280): a, c, t, g, unknown or other
  misc_feature (280)..(280): n is a, c, g, or t
  modified_base (406)..(406): a, c, t, g, unknown or other
  misc_feature (406)..(406): n is a, c, g, or t
tcagagactatactcacgaccggtgctcgatttagctcgatatagttgggtttggggctggggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccgggggaggcttggtccaggccgggggggtccctgaaactctcagtgtgcaggctctggattccanttaccagtgactcggctatactacgttgggtcccgccagtctcggacccggggaaagggcgtgggagtcggtcgttcgggccgttagttaacgaaccaaacctgaacgaagtacacgataatttgngtctcgcgtacggtgacgaaggtctaggttcctaacctactctacagtacgatgacgttacgagacgaacgacgtacgttactctagtactaacgtacgaacgtacgtaccgtaacgaaaccgaacggacgaaccggtaccgttagttacgtttaacgtcggtcgtaccgtaacgtaccgtacgttaccgttacgttagtttaaccgttcgtttttacgtacgttaggtacccg

SEQ ID NO: 60016 - DNA, 714 bp, Homo sapiens
  misc_feature: GYAE6OF02G13VZ.26.57.F02.1.454.CMB.1.raw
  modified_base (391)..(391): a, c, t, g, unknown or other
  misc_feature (391)..(391): n is a, c, g, or t
tcagagactatactcacgaccggtgctcgatttagctcgatatagttgggtttggggctgggagaggagctccagccttgggattccccagctgtctccactcggtgatcggcactgaatacaagagactcaccatggagtttgggctgagctgggttttccttgttgctattttaaaaggtgtccagtgtcaggtgcagctggtggagtccgggggagcgtggtccaggccggggggtccctagaactctcatgtgcgaggctcgtggattcgaccaattccagtggactcggtctatatacgtcggtccgccagtctggacccggaaaggcctggacgtgcgttggcgtatacgaacaaacctgaactaagtacgcgtaactaatttancggccttgaccggttcggtacggccaaagggtcctacggttaccaacccgacttcctacccgaagagaagtacgtaagttacgaaggtaacgaacgtaaccgggacctaacgtccgtaacgactaaaacgtacgtaaaccgaccggtaccctaaacggggaaaaacccgttaacggggaaacccaacccggggtacccgttaacggttactttaaccggttcggttaacccgacccgtaaacggtaacctaaccgttacccgttacggtttaaacctttaacggtttaaccttttttaccgtagggttaccgttaacccccgg

SEQ ID NO: 60017 - DNA, 663 bp, Homo sapiens
  misc_feature: GYAE6OF02GXURH.26.57.F02.1.454.CMB.1.raw
  modified_base (414)..(414): a, c, t, g, unknown or other
  misc_feature (414)..(414): n is a, c, g, or t
tcagagactatactcacgaccggtgctcgatttagctcgatataggttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttggtccgaggcccgggggggtccctgaacctctcatgtgcaggctctggattcactattcagtcgactcggctatactacgtcgggtcccgccagtcgtcggaccggggaaagggctgggagtgggtcgttgggtccgtaagttaacgaaacctaaaccgtgaacgtaagtacgacgtaataatttagngtactgccgtcggtcgacgaaggcgtacggtaccacctactcctacgagagtatcgaacttacgaagaacgaaccgacggtacgtacgtctacgacaaagtacgaaaccgacgaccgtaaacggaaaccggaacgggaacccgaacgggtaccgttagttacgttaccgtaggtaccgaccgtacgaactacgttacccgttacgtttacgtttaacgtttactttttacgtacggttacggttacccg

SEQ ID NO: 60018 - DNA, 752 bp, Homo sapiens
  misc_feature: GYAE6OF02I8K4P.26.57.F02.1.454.CMB.1.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccgggggaggtcgttggtccgagggccgggggggtccctagaaaccgtctcgattggngcaggcctcgtggtattccacattcgagtgacgtcggntatatacgtgggtccnccgtagttctcggaccggggtaaggtcgtagggtgtgggtcgttgggaccgttagttaacggaaccctaaaccgttacgaacgtaacggtacgaccggtaactaaagttttgacgtcgttcgggtaccgggttcggtacggaccgaaacggggtccgtaaccggtttaccgaacctacgtttcccctacccgaaagtacggtaagttacggtacgttacgtaacgggaaacgtaaaccggacgggtacccgttaatccggtaccgtaactaaacgtacgaaccgtaacgaccgtaacccgaaaacgggaaccggtaacgaacccggggttaccgtacgggttactttacgtggtcccggtacaacggtacctacgttaccgttaccgttagtttaccgtttactttttacggacggttacgttacccgg

SEQ ID NO: 60019 - DNA, 848 bp, Homo sapiens
  misc_feature: GYAE6OF02HCTUZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggcccggggggttccctaggaaactctcatggtgcaggctcgtggtattcactattcgagtgactcggcttatactacgtcgggtcccgaccgtacggtcgtacgggaccgggaaagggtccgtaggaggtcggtcgttgggaccgttattaacgaaacccgtaaacctaggaaccgtaaggtaaccgacgtaacgtaaactttagtacgtaccgttcggaccggttagggtacgaacggtaacgggtcgtaacgggttaccaacccgtacgttaacccgtacccgaaagggtaacgttaacgttcggtaaacgtttaccgaaagggtaaaccggtaaaacccggtaaacgggttacccggttaacgttaccccgtaaggtaaacccgtaaaaaggttaaccggaaaaccgttaacccgtaacccggttaaaacgggaaaaaaccccgggacggggtaaaccccgtaaccgggtacccggtttagttaacccgttaacggttacgggtacccgtaacccggaacgttaacccgttaaccgtaacccggtttaacggtttaaccgttttaaccggtttttaaccgtttttaaccgggtacgggtttccggttaacccccggg

SEQ ID NO: 60020 - DNA, 654 bp, Homo sapiens
  misc_feature: GYAE6OF02IYKE9.26.57.F02.1.454.CMB.1.raw
  modified_base (429)..(429): a, c, t, g, unknown or other
  misc_feature (429)..(429): n is a, c, g, or t
tcagagactatactcacgaccggtgctcgatttagctcgatatagttgggtttggggctgggagaggagctccagccttgggattcccagcgtgtctccactcggtgatcgacactgaatacaagagactcaccatggagtttggctgagctgggtttcctgttgctatttaaaggtgtccagtgtcagtgcagctggtggagtccgggggagtcttggtccaggccggggggtccctggaaactctcgagtcgtgcgacggtctcgtggtattcactagttcagtcgactcggctatatacgtcggtccgccgagtcgtcgaccggaaacggtctagggacgtggtcttacggaccgtaagttacgaaaccctaaacgtgaaccgtaagtaccgacgaacgtaaacgtttagcgtcttgacgttcggngtacgaacggcgtacgggttcaaccgtactccgtaccaggtactagtagtacgttccgaagaacggtaacacggtaccgtatacgtcgacgaaagttaccgaacacgtacctaacgggaaaccgaacggacaaccgggtccgtagtacgttaacgtcggtcacccgaataacctcgttaacccgttcgttaagttacgttacttttacgacggttcgttaacccg

SEQ ID NO: 60021 - DNA, 574 bp, Homo sapiens
  misc_feature: GYAE6OF02INKJL.26.57.F02.1.454.CMB.1.raw
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctatttaaaggtgtccagtgtcaggtgcagctggtggagtccgggggaggcttggtccagccgggggggtccctgaaactctcatgtgcaggctctggattcanattcagtnactcggctatatactagggtccgccaggtctggaccgggaaagggcgtggagtggctggccgtatacgaaccaacgtgacaagtacncgaactaatttangctgcgtacggtncgaagcgagtcacgatctacagagatgatcgagaagacgacgacgtatcaggaccaagacgaacgagaccgtaacggaaaccgaggacgaaccggtccgtaggtactacgtggtcgaccgagaaccctacgttacccgtcgttaactttacgttacgtttttccgtaggttacggttaacccg

SEQ ID NO: 60022 - DNA, 648 bp, Homo sapiens
  misc_feature: GYAE6OF02GP7CK.26.57.F02.1.454.CMB.1.raw
  modified_base (307)..(307): a, c, t, g, unknown or other
  misc_feature (307)..(307): n is a, c, g, or t
  modified_base (393)..(393): a, c, t, g, unknown or other
  misc_feature (393)..(393): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggagtttgggctgagctgggttttcctgttgctatttaaaaggtgtccagtgtcaggtgcagctggtggaggtccgggggagcgttggtccgaggccggggggtccctgaaacctctcatgtgcagctctggattcactattcagtgctcggcttatatacgtcgggtcccnccgagtcgtggaccgggaaaggcgtagggagtggcgttggccgtagttacgaaccaaacgtgacaaggtacgcgaactaatttagngtctgcggttcggtgcgaaggcgtacggtaccaccgtacgtccgtaccgagagtagtacgtactcgaagtaagaacgacggtacgtatacgtagtaacgaaagtacgaaaccgtacggtaaccgtaacggaaaacccgaacggaaccggtaccggtaccgttacgtacgttacgtacggtcgtaccgtacgacgttaccgttaccggttacgttaacgttaccgtttacgtttttacgtacggttaccgtaccgg

SEQ ID NO: 60023 - DNA, 616 bp, Homo sapiens
  misc_feature: GYAE6OF02FVCWN.26.57.F02.1.454.CMB.1.raw
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctaggaaactctcatgtgcaggctcgtggattcactattcagtgactcggctatatacgtgggtccgccgagtctggcccggggaaagggctgggagtcggcttgggccgtagttacgaacccaaactcgaacaagtacgcgaacaattttatgcgtgcgtcgggtgacgaaggccgtaggtcaccatctccagantagattanagaagaacgacggcgtactctagacaacgtgaaccgagaccgtaacggaaaacccgaggaaccgaccggtaccggtacgtacttacgtggttcgaccgtaacgaaccgtacgttaccgttaccgttacgttttaaccgttaacgtttttttcgtacggttccggttacccgg

SEQ ID NO: 60024 - DNA, 697 bp, Homo sapiens
  misc_feature: GYAE6OF02FXATX.26.57.F02.1.454.CMB.1.raw
  modified_base (309)..(309): a, c, t, g, unknown or other
  misc_feature (309)..(309): n is a, c, g, or t
  modified_base (423)..(423): a, c, t, g, unknown or other
  misc_feature (423)..(423): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggaggcttggtccaggccggggggtccctgaaactctcatgtgcaggctcgtggattcactattcagtgactcggactatactacgtcgggtaccnccgagttccgtcggaccggggtaaagggccgtggggaacgtgggccgtttgggaccgttaagttaacggaaaccgaaaccgtgaacaaacggtacgacgtaactaaagtttagngtacgtgcggttcggtagaccgtaacggcgtacggttcaaccgtactacctaccgaagtacgtaagtacgtactacgaacgaacgaaaccgtacggtacgttacgtacgtacgtaacctaaacgtacgaaacgacgaaccgtaacggaaaaccggaacggaacccgaccgggtaccgttacgttacttacgtacggttcgaccgtaacgtaaccgtacgttaccgttacgttaacgttaccgtttacgtttttaccgtacgttaccggtacccg

SEQ ID NO: 60025 - DNA, 673 bp, Homo sapiens
  misc_feature: GYAE6OF02IR0VN.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccggggggaggcttggtccgaggccgggggggtccctgaaactctcatgtgcaggctcgtggattcacattcagtgactggctatatactggggtcccgcagtctggaccggggaaagggctgggagtggcttggccgttaatagaaccaaactgaacaagtacgacgaactaatttatcgctgtcgtcggtgacgaaggcgtaggttcaacctactctaccgagagatgtatcgaagaagaacgaccgggcgttaactccgtagaacgaaagttacggaaacaaccggtacccgtaaacgggaaaaacccggtacgggaaacccggaaaccggggtacccgttacgttaagttttaccgtaggtccggtaacccgaaggtaaccctaccggttacccggtttacgtttacgtttttaaaccggtttctttttttaaccggtacggttggttaacccccgg

SEQ ID NO: 60026 - DNA, 679 bp, Homo sapiens
  misc_feature: GYAE6OF02GLD3B.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggttttccttgttgctattttaaaaggtgtccagtgtcaggtgcagctggtggaggtccgggggaggtcgttgggtccgacgggtcccgggggggtccctaggtaaactctcagtgtgcaggtctgtggattcactattcaagttgacctcggctaatactacgtgggtccccgccaggttcgtcggaccggggaaagggcgttgggaggtggcgttcgggaccttagttaacgaaacccgtaaaccgtgaaccgaaagtaccgacgaactaatttagtgtaccgtggtccgtcgggtggacaacggtcgtacggttacaccgtactccgtacgaggtagagttaggtcttacgaaggaacgaaccgacgggtaccgtatccgtagaactaaagtcgaacgacgaccgtaacgaaaccggaagaccgtacggttacgtacgttacttacgtcgtacgaccgtacgaccgtacgttaccgttacgttcgtttaacgtttacgttttacgtacggttcgttaacccgg

SEQ ID NO: 60027 - DNA, 681 bp, Homo sapiens
  misc_feature: GYAE6OF02F18M6.26.57.F02.1.454.CMB.1.raw
  modified_base (414)..(414): a, c, t, g, unknown or other
  misc_feature (414)..(414): n is a, c, g, or t
tcagagactatactcacgaccggtgctcgatttagctcgatatagttgggtttggggctgggagaggagctccagccttgggattcccagctgtatccactcggtgatcggcactgaatacaagagactcaccatggagtttgggctgagctgggttttccttgttgctattttaaaaggtgtcctagtgtcaggtgcgagctggtggaggtccgggggaggtcgttggtcccgaggtcccgggggggtccctagaaactctcatgtgacgaggctctgggattcgactattcagtcgacgtcggctatatactgggtcccgccagttctggccgggaaagggcgtagggagtcgggcttcgggcgttattacgaaaccaaacctgacaacggtaacgcgtaactaaatttacngactggtcggtcggttaggacctaacgggcgttagggttccgaaccctacgtaccgttacccgtaacggaacgtagttaggtaactttacgaaggtaaacgaaccgacgggtacgtaacgtcgttacggaacctaaagtacgaaacgacgtaaccgtaaaggtaaaacccggacggaaaccggaccgggtccgttagtacgttacgtgtcggccagtaccacgttcccggtacttagttacgtttacttttacgaggttccgtaccg

SEQ ID NO: 60028 - DNA, 835 bp, Homo sapiens
  misc_feature: GYAE6OF02JCKY9.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaaggtgtccagtgtcaggtgcagctggtggagtccgggggagcgttggtccgacggccggggggtccctagaaacctctcagtgtgcaggctctggtattcactattcagtcgactcggctatagtacgtgggtcccgcctagttcgtacggacccggggaaaagggtcgtaggggtagtcgggtccgttcgggtcccgttaagtttaacggaaaacccctaaaccgtcggaaacccgtaaaggtttaccgggaccgtaaccgttaaaacgttttaacgtcgggtaacccttgggtaccggtttaccggggtacgtaaccgggaaacggtccggtaacgggttacccgtaacccgtaacgttacccgtacccgaaggtacgaacgttacgtaacgttacccgaacggtaaacgtaaccggtaaccgggttaaccgttaacgtacccgttaacgaaacgtaaaacgtaaccggaaacgtaaccggtaacccgtaaacgggaaaaccccggtaacgggaaacccggtaaccgggtccggttaaggttaccgtttaacggtacggttaccgaaccgtaacggtaacccgtacggttacccggttaccggtttaacgtttacccggtttaactttttaccggtaccggttccggttaaccccgg

SEQ ID NO: 60029 - DNA, 664 bp, Homo sapiens
  misc_feature: GYAE6OF02IQ4ZA.26.57.F02.1.454.CMB.1.raw
  modified_base (314)..(314): a, c, t, g, unknown or other
  misc_feature (314)..(314): n is a, c, g, or t
  modified_base (388)..(388): a, c, t, g, unknown or other
  misc_feature (388)..(388): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctggtggaggtccgggggaggtcttggtccgaggcccgggggggtccctgaaactctcatgtgcaggctcgtggattcgacattcagtgactcggctatatacgtgggtcccncgagtctggaccgggaaggctgggagtggcttggcgtattagaaccaactgaacaagtacgacgactaatttangctgcggtcggtgacgaaggctaggtccaacctatccctacgaagtagtatagtattcgaagaacgaacgacggtagtatacgagaacaaagtacgaaacctaggacccgtaaacggaaaacccggaacgggaaccgtaaccgggtaccgttagttacgtttaaccggtaggttaccggaacccgtaacggaaccgttacccggttaacccgtttaccggtttaaacgttttacccgtttaaggttttttaaccgacgggtttcccgttaacccgg

SEQ ID NO: 60030 - DNA, 869 bp, Homo sapiens
  misc_feature: GYAE6OF02I20RM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggtttccttgttgacttaagtttaaaaggtgtaccgagtgtcgaggtgctagcgtggtgggacggtccgggggaggtcgttcggtccgacgggtcccggggggtccctaggaaacctccgtcagtggtcgacgtacggtccgtcgtacggtattaccactacgtttaccaggtacgtaccgtccggtattaagtaacgttacggtaccgggtacccgacgtaacggttccgggacgggtaacccgggggtaaacggggtcgtaagggtcggtcgggtacccggttacggtaccgttaacttaaaccggaaaccctaaaccggtacggtaaacgtaacggtaaccggactaacgttaattaagtcgtacggttaccgacgggttaccgggtacgacggtaaacggtacgttaaccggttacctaacctacgttacccgacgtaacggtaacgaggtaacgttaccggttaacgaacgggaaacgtaacggtaacggtaccggttaagtaccggtttaacgaaacgttaaacgaacgggttaaacccaagtaaaccccgttaaacgggaaacccgggtaaacgaccggtaccgtaaccggtttaacgtacggttaacgtaacggtacccgtaaccggtaacgtaacccgtaacgttacccggttaacggttacgtttaacgtttacctttaacggtaccggttacggttaacccgg

SEQ ID NO: 60031 - DNA, 696 bp, Homo sapiens
  misc_feature: GYAE6OF02IH9NT.26.57.F02.1.454.CMB.1.raw
  modified_base (444)..(444): a, c, t, g, unknown or other
  misc_feature (444)..(444): n is a, c, g, or t
  modified_base (550)..(550): a, c, t, g, unknown or other
  misc_feature (550)..(550): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctgggtggaggtccggggggaggtcgttgggtccgagggtccgggggggtccctaggaaactctcatgtgcaggctctggtattcatattcgagtcgactcggctaatagtacgtacgggtcccgccgtaggtccgtcgggaccggggaaagggcgtgggacggtcgggcgttcgggtaccgtaagtttaacgaaaaccctaaactacgaacgtaacggtacgacaacgttaaatttaacgngtcgtggtacgtcgggtcgacgaacggctaacggttccaactactaccaccgagtagtacttaggtacttacgaaggaacgtaaaccggacggtacgtactcgtanaacgtaaacgtacgaacaccgtaccgaaacgtaaaccggacggaaccgacggtccttaaggtaccttacgtgtacgaccaacggtacctacgttacccggtttacttaacgtttacggtttattttacggcgttacccggttaacg

SEQ ID NO: 60032 - DNA, 564 bp, Homo sapiens
  misc_feature: GYAE6OF02FQJ7M.26.57.F02.1.454.CMB.1.raw
  modified_base (419)..(419): a, c, t, g, unknown or other
  misc_feature (419)..(419): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggaggcttggtccaggcccgggggggtccctggaaactctcgatgtgcaggctctggattcactattcagtgactcggactatatactgggtccgccagtctgccgggaaagggctggagtggcttggccgtatacgaaccaacgtgaacaagtacgacgactaattatgctgcgtcggtgacaaggctaggttcacgtactcncagagatgtatacagagacgacggcgtatcgtgacgaaatcgaacacgacctacgaaaaccgacggaccgacggcgtagtactactcggtcgcgaacgactacgttcccgtagtacgttaccgttacgttttcgagtcgtacccg

SEQ ID NO: 60033 - DNA, 774 bp, Homo sapiens
  misc_feature: GYAE6OF02J2APB.26.57.F02.1.454.CMB.1.raw
  modified_base (426)..(426): a, c, t, g, unknown or other
  misc_feature (426)..(426): n is a, c, g, or t
tcagagactatactcacgaccggtgctcgatttagctcgatatagttgggtttggggctgggaggaggagctccagccttgggattcccagctgtctccactcggtgatcggcactgaatacaagagactcaccatggagtttgggctgagctgggttttcctgttgcttatttaaaaggtgtccagtgtcaggtgcagctggtggagtccggggaggcttggtccaggccggggggtccctgaactctcgatgtgcgaggtctcgtaggacttacactattcgagttcgacgtccggacttatacgtacgtcgggttcccgcctagtcgtggaccgggaaagggtctagggagtcggtacgttcggaccgttagttaacgaaccgtaaacctaggaacgtaacgtccgacgtaactaatttacgngtcgtagtccggtcggtacgacgtacggtcgtaacggttccaacctactccgtacccgagtacggtagttacgtacgttagaacggaacgtaaccggacggttacgtaacttcgtacgttaacgaaacgtaacgtaaccgaaccgtaaccgtaaccgggtaaaaccggaacgggtaacccggacccgggtaccgtttaagttaacccggttaacggttaccggtacccggtaaaccggtacggttaaaccggttaacccgtttaccccgggtttacggtttaaacccgttttaaccgggtttttaaccgttttttacccggtacggtttaccccgggttaaaccccgg

SEQ ID NO: 60034 - DNA, 598 bp, Homo sapiens
  misc_feature: GYAE6OF02HB84N.26.57.F02.1.454.CMB.1.raw
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttggtccgaggccgggggggtccctgaaactctcagtgtgcaggctctggattcacattcagtgactcggctatatacgtgggtccgccagtctggccgggaaagggctgggagtggcttggccgtattagaaccaaaccgtgaaccaagtacgacgaactaatttagngctgcgttcggngacgaaggcctagggttcacctactcctaccagagatagattcgagaacgaacacggacgtactctagacaagtagaacacgacctaacgaaaccgaggaccgacggaccgtacgtacttacgtacgtcgaccgagactacgtaccgttacgttaacgttaccgtttacgtttttacgtacggttcggtacccg

SEQ ID NO: 60035 - DNA, 571 bp, Homo sapiens
  misc_feature: GYAE6OF02IMQLX.26.57.F02.1.454.CMB.1.raw
  modified_base (260)..(260): a, c, t, g, unknown or other
  misc_feature (260)..(260): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcnggctcgtggattcacattcagtgactcggctatatacgtgggtcccgccagtcgtggccggggaaaggcgtggagtggcttggccgtatagaaccaactgacagtacgacacaattatgctgcgtcggtgacgaaggcaggttcaccagtctccagagatgattcgagaagaacgacggcgtactctgacaatacgaacgacgaccgaacgaaaccgaacggaacgaccgacgttacgtagttacgtgtcgaccagacctacgtccgttacgtaagtttaccgttatttttccgtacggttacggtacccg

SEQ ID NO: 60036 - DNA, 682 bp, Homo sapiens
  misc_feature: GYAE6OF02HITOE.26.57.F02.1.454.CMB.1.raw
  modified_base (399)..(399): a, c, t, g, unknown or other
  misc_feature (399)..(399): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtggaggtccgggggaggtcttggtccgagggcccgggggggtccctagaaactctcatgtgcgaggctcgtggattcacgtattcgagtgacctcggctatatacgtggtcccgcagtctggaccgggaaggcgtggagtggcgttggccgtattacgaacctaacgtagacaaggtacgacgaactaatttangctcgcgtcggtgacgaggcgtacggttaccaccgtactcctaccgagagtagtgtacttacgaagaacgaacgacggtacgttactacgtagacctaaagtacgaaacgacggtaccgtaacggaaaacccggtaacggaaaccgtaacccgggtaccggttagttacgtttaaccgttacggtaccggtaccgaacggtaaccgtacccgttacccggttacgtttaacggttttaaccgttttaagttttttaccgtacgggtttcccggttaaccccgg

SEQ ID NO: 60037 - DNA, 742 bp, Homo sapiens
  misc_feature: GYAE6OF02IG4R5.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagcgtggtggaggtccgggggaggcttggtccgagggcccgggggggtccctggaaactccgtcatggtgcgacggtctcgttggaattccgactattcctagtcgacgtcggtacttatacgtacgtcggtcccgaccgtaggtcttacgggaccggggaaaggccgtagggaggttgggccgtttgggacccgtttaagtaacgaaaccccgtaaaaccgtacggaaccgtaaaggtacccgcggtaaaactaacgttttagtcgtactcggtccggttcgggtacgcggaagggtccgtacgggttccaacaccgttacctacgagtacgaatcgtacttacgacggaacgaacgtacggacgttagtcgtagaactaacgtaacgaacgacgtaaccgaacggaaaccggaacgaccgaccgggtacgttagttaccgttacgttcggcgtaaccgtaacggaacccgttactaacccggtttacgttaacgtttttaccgtttaacgttttttaccggtaccggtttaccgtacccgg

SEQ ID NO: 60038 - DNA, 651 bp, Homo sapiens
  misc_feature: GYAE6OF02GF51K.26.57.F02.1.454.CMB.1.raw
  modified_base (388)..(388): a, c, t, g, unknown or other
  misc_feature (388)..(388): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggagtccgggggaggcttggtccgaggccgggggggtccctggaaactcgtcatggtgcaggctcgtggattcacattcagtgacctcggctatatactgggtccgccgagtctcggaccgggaaggcgtggaggtggcgttggcgtatacgaaccaacctgaacaagtacgcgaataattntgctgcgtcgggtgcgaaggcgacgttcaccactcgtaccgagagtatagtactacgaggaacgaacgtacggtacgttacgtacgtacggaactaaagttacggaaaccgtacgtaccgtaaacgggaaaacccggaacgggaaccgaacccggggtaccgtacggttacgttaccgttacggtacgtaccgaacgtaaccgtacgtacccgttacgttaacgtttaccgtttacgtttttacgtacggttcgttaaccccg

SEQ ID NO: 60039 - DNA, 718 bp, Homo sapiens
  misc_feature: GYAE6OF02IFEAY.26.57.F02.1.454.CMB.1.raw
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (412)..(412): a, c, t, g, unknown or other
  misc_feature (412)..(412): n is a, c, g, or t
tcagagactatactcacgaccggtgctcgatttagctcgatatagttgggtttgggggctgggagaggagctcccagccttgggattcccagctgtctccactcggtgatcggcactgaatacaagtagactcaccatggagtttgggctgagcgtgggttttccttgttgctaattttaaaaggtgtcagtgtcaggtgcagctggtggaggtccgggggaggcttggtccaggccgggggggtccctggaaactctcatcgtgngcggctcgtggacttnactattcagtcgactcggcttatatacgtggtcccgcagtctggccgggaaagggctggagtcggtcgttacggtccgtaagttaacgaaaccaaaaccgttagaacgtaagtacgacgaactaatttangctgcgtcgtgcgaacggcgtacgttccacgtactcctacaagagtgtactagttacgaagtaacgaacgacggtacgtaactacgtcgtaaaccgtaaagtaacgaaaccgaacggtaccgtaaaacgaaaacccgggaaacggtaaaccggaacccgggtaccggttaagtttaacgtttacccgttaagggttcccgaccggtaaccgtaaaccgttaaccgttacccggtttaacgtttaaccggttttaaaccgttttaacggttttttttaccgtaccgggtttaccgggttaacccccg

SEQ ID NO: 60040 - DNA, 658 bp, Homo sapiens
  misc_feature: GYAE6OF02GOB6R.26.57.F02.1.454.CMB.1.raw
  modified_base (275)..(275): a, c, t, g, unknown or other
  misc_feature (275)..(275): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtccctagaaactctcatgtgcaggctctggattcactnttcagtgactcggctatactactcgggtccgccgagtcgtcggccggggaaagggtcgtgggaggtggtcttgggccgtattaacgaaccaaaccgtgaacgaacgtacgacgtaactaatttagtgtcgtagtcgtcggtgacgaaggcgtaacgtccacctatcctacgagaggattgtacttacgaagaagtaaccgtacggtacgttactcgtacgaacgtaaaacgtacgtaaaccgacgtaccgtaacggaaaaccggtacggaaaccgaccggtaccgttacgttaagttacgtagtaccggtacctaacggtacctaacgttacccgttacgttatttaaccgtttagtttttaacgcggtttaccgttacccgg

SEQ ID NO: 60041 - DNA, 701 bp, Homo sapiens
  misc_feature: GYAE6OF02GJKYN.26.57.F02.1.454.CMB.1.raw
  modified_base (431)..(431): a, c, t, g, unknown or other
  misc_feature (431)..(431): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttggctgagctggttttccttgttgcttattttaaaaggtgtccagtgtcaggtgcagctggtggagtccgggggagcttggtccgaggccggggggtccctggaaacctctcgatgtgcgaggtctcgtggattccagtattccagtcgactcggcttatagtacgtcgggtcccaccagtctcggcccggggaaaggtccgtgggtaagtgggtccttgggccgttaagttacgaaaaccccgtaaaccgtggaacctaaacggttaccgacggtaacctaagttttacncgtacgttcgccggttacgggttggaccgaaaggggtcctaaggggtttcccaaaccctacgttccttacccgaggtaacgtagttaacgtacttacgaacgtaacggaacgtaccggtacgttagtccgttaagactaaacgttacgaaactacggtacctaacggaaaaccggaacggaacccggaacggcccgttagtacgttcgtaggtcgacctaaggaccacgttccgattacgttacgttaacttttcgtaggtcgtaacccg

SEQ ID NO: 60042 - DNA, 842 bp, Homo sapiens
  misc_feature: GYAE6OF02HB1BB.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtaggtttgggctgagcgttgggttttccttgttgtcttaattttaaaaggtgtccgtagtgtcaggtgcagtcgtgggtgggacgggtccgggggaggtcgttcggtccggacggggtcccgggggggttccctacggtaaaccttcgtacctagttcggtggcgaggtccgtcgtgggtacttccactattacgaggtacgtaccgtcggacttaagtagtaaccggtcgggtcccgacctacggttccgtacgggaaccggggtaaacggaccgtaggggtacggttcgggtaccggttcgggacccggtttaattaaccggtaaaaccccgtaaaccgtacgtaaaccgtaaacggtaaccggacgtaaacgtttaaacgtttacgtggtaccgttcgggtaccggttcggtacggtaccggaacggtaccgtaaccgggttcccaaacgtacgtcccgtaccggtaaagaggtactggtaacttcgaaagggtaaaccgtaaacccgacggggttaccttaacgtacccgtaagtaaaccgaaagtaccggtaaaccggacggttaaaccccgaaaagggtaaaacccggtaacggaaccggtaccgggtacgttacgttacgttcgttaccggacgaccgagtaccctacgttaccgttacttaaccgttattttacgttttaccgacggttcccgtacg

SEQ ID NO: 60043 - DNA, 608 bp, Homo sapiens
  misc_feature: GYAE6OF02H5OHM.26.57.F02.1.454.CMB.1.raw
  modified_base (292)..(292): a, c, t, g, unknown or other
  misc_feature (292)..(292): n is a, c, g, or t
  modified_base (407)..(407): a, c, t, g, unknown or other
  misc_feature (407)..(407): n is a, c, g, or t
tcagagactatactcacgaccggtgctcgatttagctcgatatagttgggtttggggctgggagaggagctccagccttgggattcccagctgtctccactcggtgatcggcactgaatacaagagactcacatggagtttggctgagctgggttttccttgtgctatttaaaggtgtccagtgtcaggtgcagctgggtggaggtccggggggaggcgttgggtccgagggcccggggggggtccctaggaaactcgtacatggtgcaggctcgtggattcacattcagtnactcggctatatacgtgggtcccgcctagtcgtaggacccgggaaagggtccgtgggacggtgggtcttgggccgtagttagaaccaaacctgacgaagtacgcactaatttacngtctgcgtcggtgcgaaggcgtagtcaccgactctccagacgagttagacttcgaagacgaaaccgacggcgtaatcgagacaaagtacgacaacgccaacggaaaccgaggaccgaacgccgttatacgttacgtagcgaccgacgtactacgtaccgttacgttaagttacgtttactttttacgtagttccgtacccg

SEQ ID NO: 60044 - DNA, 801 bp, Homo sapiens
  misc_feature: GYAE6OF02IZF37.26.57.F02.1.454.CMB.1.raw
  modified_base (288)..(288): a, c, t, g, unknown or other
  misc_feature (288)..(288): n is a, c, g, or t
tcagagactatactcacgaccggtgctcgatttagctcgatatagttgggtttggggcgtgggagaggagctccagccttgggattcccagctgtctccactcggtgatcggcactgaatacaagagactcaccatggagtttgggctgagctgggttttcctgttgctatttaaaaggtgtccagtgtcaggtgtcagctggtggagtccgggggagtcttcggtccgaggtccgggggggtccctaggaaactccgttcagtgtcgcgaggctcgtggacttcacnttcagtcgactcggctatatacgtcggtccgtaccgagttcgtacggtcccggggaaaagggtcgttacggggaacggtcgggtaccggtttcgggtacccgggttaagtttaacggaaaaccccgtaaaaccgttaggaaaccgtaacggtaccgggacgtaaacctaaattttaaccgtggtacgttaccgggacggtttaccgggtaacgtaaaacggggtaccgtagggtttacccgtaaacccgtaacgttacccgttaacccggaaccgggtaagtaacggtaccggtaagtttaacgacggtaaacggaaccggtaaccggtacgtaacgtaccgtgtaaccctaaagtaacgaaaccgtaacggtacctaaacggaaaacccggaaacggtaccgaaaccgggtacgtacggttaacgttacgtacggtcgaaccgtacgtaacctacgtacccgttaacgttactttacgttacgttttacgtacggttacggttccgtaacgg

SEQ ID NO: 60045 - DNA, 674 bp, Homo sapiens
  misc_feature: GYAE6OF02HTE8A.26.57.F02.1.454.CMB.1.raw
tcagagactatactcacgaccggtgctcgatttagctcgatatagttgggtttggggctgggagaggagctccagccttgggattcccagccgtctccactcggtgatcggcactgaatacaagagactcaccatggagtttgggctgagctgggttttccttgttgctattttaaaaggtgtccagtgtcaggtgcagctggtggaggtccgggggaggtcgttggtccgaggcccgggggggtcctggaaacctctcatgtgcgaggctcgtggattcactattcagtcgacgtcggctatactagtcgggtccaccgtacggtcgtcggaccggggaaagggccgtagggagggttggtccggtttacgggtaccgttaagttaacggaaaccctaaaccgttagaacgtaaggtaccgacgtaactaaagttttactgtctgtccggtacggtacgacgaacggtcgtacgggttaccaaccgtatacctacgagagtaagtagacttacgaaggtaacgaacgtaccgacgtactcgtagaactaaagtacgaacacgtaccgtaacggaaaccgacgacggaccggtacgtagttagttacgtgtacggcgtaacgagtaccgttcgttacgttatttacgttattttcgtacggttcgtccgtacgg

SEQ ID NO: 60046 - DNA, 710 bp, Homo sapiens
  misc_feature: GYAE6OF02GHYSP.26.57.F02.1.454.CMB.1.raw
  modified_base (261)..(261): a, c, t, g, unknown or other
  misc_feature (261)..(261): n is a, c, g, or t
  modified_base (450)..(450): a, c, t, g, unknown or other
  misc_feature (450)..(450): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgtgctattttaaaggtgtccagtgtcaggtgcagctggtggagtccgggggaggcttggtccaggccggggggtccctgaactctcatgagcgaggctntggtattcactagttcagtgaccgtcggactacgtagtaccgttcggggtcccgccgtacgtcgtacgggaccggggaaacggggctacgggtagtcgggtcgttcgggtacccgttaagttaaccggaaaccctaaaccgtcgaactaacgtacgaccgtaataagtttatgacgtcgtcggtccggngacgaacggtcctacgggttaccaacctagttccctaccgaagacgtagtagtacttacgaaggaacgaaccgacggtacgtacgtcgtacgaacgtaaatacggaacctacgaaccgtaaccgaaaacgggtaccggaccgtaaccggggtcccttaggtttacttacggttacggtaccggaacctacggtacccttaccgttaccgttaccgtttaaggttaccgtttacgttttacgtaacggttccggtaacccg

SEQ ID NO: 60047 - DNA, 731 bp, Homo sapiens
  misc_feature: GYAE6OF02JX9AT.26.57.F02.1.454.CMB.1.raw
  modified_base (208)..(208): a, c, t, g, unknown or other
  misc_feature (208)..(208): n is a, c, g, or t
  modified_base (279)..(279): a, c, t, g, unknown or other
  misc_feature (279)..(279): n is a, c, g, or t
tcagagactatactcacgaccggtgctcgatttagctcgatatagttgggtttggggcgtgggagaggagctccagccttgggattcccagctgtctccactcggtgatcggcactgaatacaagagactcaccatggagtttgggctgagcgtgggttttccttgttgtcttattttaaaaggttagtcctagtgttcgaggttgcngcgtggttggaggtccgggggtaggtcgttcggtccgacggccgggggtcccggtgaaactctcatgtcgngacgctcgtcggatacgactagtctagtgaccgtggtcctagttatacgttcgggtccgccgtagccgttaggccgggtaaacgggcgtcgggtagtcgggtcgttcggtcgttacgttaaaccgaacctaaaccgtacgtacgaaacgttaccggcgaaaccgttaatttacgagtccgtagtcccggttcgggtagtacggaacggttcgaacggtttccccgaccttaactcgtcccgaaaggtataacgtgtacgttacgagacgtaaacgtaccggtacttacgtcgtaacgaactaacggtaacgaaccgtaacgtaccggtaacgaaaaccggacgaccggtaccggacggtttactacggttacgtggtaccgtacgaagtaaccctcggtttacccgtggttaactttaccgtttagttttacggttaccggtaccggttacg

SEQ ID NO: 60048 - DNA, 562 bp, Homo sapiens
  misc_feature: GYAE6OF02F4N7U.26.57.F02.1.454.CMB.1.raw
  modified_base (376)..(376): a, c, t, g, unknown or other
  misc_feature (376)..(376): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccgggggggtccctgaaactctcatgtgcaggctctggattcacattcagtgactcggctatatactgggtcccgcagtctggccgggaagggctggagtggcttggccgtattacgaaccaactgaacaagtacgcgataatttangctgcgtcggtgcgaaggcaggttcacatcctcagagatgattcgagaagaacacggacgtatctagacaaagtagaacacgaccgtaacgaaaccgaggaccgacggtccgtagttacttacgtgtcaccagtacctacgtcccggttacgttacgttacgtttatttttcgagttcggtacccg

SEQ ID NO: 60049 - DNA, 700 bp, Homo sapiens
  misc_feature: GYAE6OF02I152Q.26.57.F02.1.454.CMB.1.raw
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
  modified_base (188)..(189): a, c, t, g, unknown or other
  misc_feature (188)..(189): n is a, c, g, or t
  modified_base (198)..(198): a, c, t, g, unknown or other
  misc_feature (198)..(198): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (391)..(391): a, c, t, g, unknown or other
  misc_feature (391)..(391): n is a, c, g, or t
  modified_base (473)..(473): a, c, t, g, unknown or other
  misc_feature (473)..(473): n is a, c, g, or t
  modified_base (549)..(549): a, c, t, g, unknown or other
  misc_feature (549)..(549): n is a, c, g, or t
  modified_base (642)..(642): a, c, t, g, unknown or other
  misc_feature (642)..(642): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttctgtggctattaaaggntcagtntcgagtnngtctggagngtcgggagctggcagggtccggggtccagaactctcagttgcgacnggtctcgtggcttacnctatacgagtagcgttcggtactatacgtactccggggttccaacgttcgtcccgttagggaaccgggaaggtccgttggacggtacgggtcttacggggacttttaacggtaacgaaaccggttaaaccncgtaaacccgtaagggttaacgaccgttaacctaaagtttccgtgtaacggtttcaccggttttgggaccgagtaacgggtntaccggttacctaaccgtctaacggtcccagggaaacctgtaaccgtagtacgaacggagtaaacgcgactttaanaccgtgtaaaccagtaaaacggtcgaaaccgaccttaaaacgggtcgaaacccgtcggacccgaaggtttcctacgttacggtcgaaccgtanaacggtcctagtaccggttacctacggtttacgttacggttaacctcggtcccgtaag

SEQ ID NO: 60050 - DNA, 792 bp, Homo sapiens
  misc_feature: GYAE6OF02IVIYI.26.57.F02.1.454.CMB.1.raw
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagcgtggttctgtgctatttaaagtgtcagtntcagtgcagntcggtggnggtccgggggaggcttggtccgaggccggggggtaccctggaaacctctccgatgagcnggcttcgtggtaactcacattcgagtgacttcggctaagtactacgttcgggttccnccgtaagtccgtacggaccggggtaaaggtcgtgggaacggtcggtacgttcgggtacccgttaagttaaccgtaaaacccgaaaccttacggaaaccgtaaacggtaaccgtaccggtaaacctaaagttttacgtaacgtcgttcgggtaccggttacgggtacgtaccggaaacggcggtaaacgggttacctaaccgtactacgttaacccgagtacgtaagtacgtacgttacgaacgttaacggaacgaccgggtacttaactcgttacgaaccgtaaagttcgaaacccgacgaaccgttaaacggaaaccggaacggttaaaccggtaccgggttaaccgttacggttaacgttacccggtttacggtaccggtaccgtaagggtaacccttaccggttaccgggtttaaccgtaaggtttttaacccgttttagtttttaaccggtacgggtttcccgttaaacccgggg

SEQ ID NO: 60051 - DNA, 653 bp, Homo sapiens
  misc_feature: GYAE6OF02JI2AK.26.57.F02.1.454.CMB.1.raw
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (413)..(413): a, c, t, g, unknown or other
  misc_feature (413)..(413): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatgagtttgggctgagctggtttccttgttgctattttaaaggtgtccagtgtcaggtgcagctggtggagtccgggggaggcttggtccaggccggggggtccctggaaactctcatgtgctaggctctggtattcgactattcacgtgactcggtactatntacgtgggtcccncgtagtcgtcggaccgggaaggtctcggagtcggtcgttggtaccgttagtaacgaaacccgtaaccgtgaaaccgtaacggtacgacggtaactaatttacgngcctaggtaccgttacggtacgacgtaacgcgtaacggtacaacccattcccgtaccaagtaacgattacgattacgaagtaacgaacgacggtactatcgagactaatacgaaccgtacgtaccgtaacgaaaccgaaggacccgaacgggtccgttagtacttacgagtaccgtaccaaggaccctagttacccgtagttaaccggttacttaacggttttacaccgtttagaacccg

SEQ ID NO: 60052 - DNA, 639 bp, Homo sapiens
  misc_feature: GYAE6OF02IFQAZ.26.57.F02.1.454.CMB.1.raw
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (322)..(322): a, c, t, g, unknown or other
  misc_feature (322)..(322): n is a, c, g, or t
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
  modified_base (519)..(519): a, c, t, g, unknown or other
  misc_feature (519)..(519): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgtgctattttaaaaggtgtccagtgtcaggtncagctggtggaggtccgggggaggcttggtccagggccggggggtccctgaaactctcatgtcgcgaggcctgtggnttccgactattccagtcgaccgtcggaccttatactacgtcgggtcccnccgtaggtctcgggaccgggaaggtcgtggnggtggcgtggtaccgtataacgaacctaaactgacaaggtacgacgaactaagtttcngtctaggcgttcgggtnacgaggtacgtacggttccaaccattccacgagagtagtacgattacgaagtacgaaccgacggtacgtactcgagtacaaagtacgaacncgtaccgaacggaaccggaacgaccgtaccggacgttagttaccgttagtcggtacgctaacggactaccgttaccgttacttaacgtttacgttacgtttttacgacggttcgtaaccg

SEQ ID NO: 60053 - DNA, 704 bp, Homo sapiens
  misc_feature: GYAE6OF02JYLNV.26.57.F02.1.454.CMB.1.raw
  modified_base (237)..(237): a, c, t, g, unknown or other
  misc_feature (237)..(237): n is a, c, g, or t
  modified_base (442)..(442): a, c, t, g, unknown or other
  misc_feature (442)..(442): n is a, c, g, or t
  modified_base (636)..(636): a, c, t, g, unknown or other
  misc_feature (636)..(636): n is a, c, g, or t
  modified_base (648)..(648): a, c, t, g, unknown or other
  misc_feature (648)..(648): n is a, c, g, or t
tcagagactatactcacgaccggtgctcgatttagctcgatatagttgggtttggggtcgtgggagaggagctccagccttgggattcccagctgtctccactcggtgatcggcactgaatacaagagactcaccatggagtttggctgagcgtggttttcctgttgtcttattttaaaaggtgttccagtgtcgaggtgcagctggtggaggtccgggggaggtcgttggtaccgngggtcccggggggtcctaggaaactcgtcgagtcggtgcgacggtctacgtggacttcgactatacgagttacgacgtcggctaagtagtacgtcgggtccgccgtacgtacgtcggacgggtaaaggccgtagggagtcggtacgtggtaccgtattacgaacctaaccgtagaacctaaggtaccgacgaacttaagttacgntacgtacggtcgtacggtgaccgtagtacgtagtcaacctacgtacctacgtaaggactacgtagtaacgttcaaagtaacgaccgtacgggtatagtccgtagtaaaccaagtaccgaacagtaacccgtaaaggaaaacccgtaggaaccgtaaccgggtcgtaacgttacgtaccgttaaggccgaaaccncggttaaacccncggttaacctacggtttacgtttaagtttaccctttaaggttccgtacggttaccg

SEQ ID NO: 60054 - DNA, 830 bp, Homo sapiens
  misc_feature: GYAE6OF02I1X5D.26.57.F02.1.454.CMB.1.raw
  modified_base (162)..(162): a, c, t, g, unknown or other
  misc_feature (162)..(162): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtntaggctatttaaagtgtcagtgtcaggtgcagctggtggaggtccgggggagcttggtccaggccggggggtccctgaactcgtcatgtgacgcggctcgtggattcacgtatttccaggttacgacgttccggtactaacgttagtaccggttcgggtacccgtcccgtaaggttccggtcgggtaacccggggggaaaggggtccgttaggggtaacgggttcgggtccggtttaggggtaccccggttaaagtttaaacgggaaaccccctaaaaacccggtgtaaaccgaaacggttaaccggaaccggtaattaaactttggtcggtactcgggtacggtttccggaggtacccgaaagggtcccgtaggtttaccgacccgtacgtcccgtaaccgaaggttactacgttacggttaacttacggaaacggttaaccgaacggttaacccggggtcttaaacgtccgttacgggaaacttaaaccggtagtaaacccgtaaacgtcccgtaaacgggaaacccgggttacgggaaaccgtaccggggtcccggttaagttaccgtttaacgtcgggtaacgaccgtaacgggttaacctccggttaccgttaacggtttaccgtttatttaaccgttttaccggcggttacccgggttaacc

SEQ ID NO: 60055 - DNA, 830 bp, Homo sapiens
  misc_feature: GYAE6OF02HSDEL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgtcttaagttttaaaaggtgtccagtgtcgaggtgcgagcgtggtaggacggtccgggggaggtcgtttgggtaccgacggggtcccggggggtccctaggaaaaccttctacgagtggtggacgacggtctcgtggtacttccgaactattacagtcgaacgtccggtcttaatagttacgtcgggtcccgtaccgagttactcggggaaccggggtaaagggtccgtgggaaggttcggtacgtttcggtacccgttaattaaccggaaaacctaaaccgtcgaaccgtaaggtaaccgacgaaacttaaattttaagcggtctcggacgttacgggtctaacggaacgggtacgtacgttacgaacccgtacttccgtaaccgaacgtaacgtaccgtagttaaacgttacgaaacggaaacggtaaaccgtaaccgggtcgtttaaaccgttacgtaaccgtaacgttaaaaacgttaccgaaaaccggtaacctaaaccgggtaaaccggtaaaaaaccggcgggaaaccgaacccggggttaccgttacgttaacgtttaccgtacggtaaccgaccgtaaagtacccgttaacggtccttaacggggtttaccctttagttttaccgttttaacggtagttacccggttaaccgg

SEQ ID NO: 60056 - DNA, 682 bp, Homo sapiens
  misc_feature: GYAE6OF02FJMT3.26.57.F02.1.454.CMB.1.raw
  modified_base (391)..(391): a, c, t, g, unknown or other
  misc_feature (391)..(391): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccggggggtcctgaactctcatgtgcaggctctggattcacgtattcagttgactcggacttatatactgggtcccgactagtctggaccgggtaaaggcctaggacgtggtcttcggcgtaattacgaacctaacgtgaacagtcgcgtaactatttacgngtctggtcgtcggtgacgaggcgtacggttcaccgtatcctacgagtagtactcgtattaccgagaaccgacgaccggtacgtacgtccgtaaggaacctaagacggtaaaccacggtaccgtaaaccggtaaaccgaccggtaaaccgaaccgggttcccgtaacgtttacgtaccgtacggtacccgaaccgtaaccggtaaccgttaccgttaaccccgggttacgttttaaccgtttaaccgggtttaccttttttaaccggtaccggtttacccgttaaccccggg

SEQ ID NO: 60057 - DNA, 892 bp, Homo sapiens
  misc_feature: GYAE6OF02HEOSQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggtcttggtccgaggccggggggtccctagaaactctcatgtgcgaggctcgtggtattccgactattcagtcgaacctcgggactaatactacgttggggtaccccgccgaggttccgtacgggacccggggtaaaagtcggggtccgttaggggacgggttacggggtccgttttacgggggttaccggttaaacgtttaaacggaaaacccctaaaaaccccggttacggtaaacctaaaacgggttaacccgggaacccggttaaaacgttaaaacgttttttaagtcgggttacccgttacggggtaccggggtttacgggttacgggaacccgggtaaaggggtacccggttaaccggggtttaccccaaaccccgttaacgtacccttacccggaaggtaacggtaagttacgtaacgttaccggaacggtaaaccggaaaccggtaaccggtaccgttacgtaccttacggaaacgtaaaacgttacggaaaaccgtaccggtaaacccgtaaaccgggaaaaccggaaacggtaacccggaccgggttaccgtacgtttaagttaccggttacggtaccgtaacccggaacgtaccgttaaccgttaccggttacggtttaaacctttacggttttaaccttttttaccggacggtttaacccgg

SEQ ID NO: 60058 - DNA, 593 bp, Homo sapiens
  misc_feature: GYAE6OF02I7PQP.26.57.F02.1.454.CMB.1.raw
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (452)..(452): a, c, t, g, unknown or other
  misc_feature (452)..(452): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggagtccgggggagcttggtccgaggccgggggggtccctgaactctcagtgtgcaggctcgtggattcactattcagtgactcggctatatacgtgggtccnccagtctggccggggaaaggctgggagtggcttgggcctagttacgaaccaactgacaagtacncgactattangactgcgtcggtgacgaagcgaggtccaccatcctcgagagactgacttcgagaagaacgacggcgtacnctacgactaaagtacgaacacgtaccgtaacgaaaccgaggaccaaccgggtcgtagtacgttacgtcgtacgtaccgaagacctagttacccgtacgttacgtttaccgtttacgtttttacgtacggttcgttacccgg

SEQ ID NO: 60059 - DNA, 793 bp, Homo sapiens
  misc_feature: GYAE6OF02I87JM.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaggtgtccagtgtcaggtgcagctgggtggaggtccgggggagtcgttggtccgacgggcccgggggggtcctagaaaccttctacagtgtgcgaggtctcgtaggtacttcactacttcgacgttgaccgttcggacttaagtacttacggtcgggtccgtacctaggttccgtacgggaccgggggaaggtccggtagggtaggtcggtcgtttcgggtaccgttaagttaaccgaaacctaaaccgtggaaaccgtaaacggtaccggacgtaaacttaaagtttgtacgtcgtcgggtaccggttcggtaggaccgaacgggtcgtacgggttacccaaccgtactccgtaacgaggtagtacgttagtaacttacggaaggtaacggaaaccgcggttacgtacgttactaacggtaacctaaagtacccggaaacgtaccggtaaccgtaaccgggaaaaccggaccgggtaaaccgtaccggggtaaccgttacgttaacgtttaccggtacggtaaccggaacccgttacgaccggttacgtttacccggttacgtttaacgtttaacccgttttagtttttcccggaaggtttcccggttaacccgg

SEQ ID NO: 60060 - DNA, 726 bp, Homo sapiens
  misc_feature: GYAE6OF02FP0GH.26.57.F02.1.454.CMB.1.raw
  modified_base (279)..(279): a, c, t, g, unknown or other
  misc_feature (279)..(279): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcctgtgctatttaaaggtgtccagtgtcaggtgcagctggtggagtccgggggagcttggtccgaggccgggggggtccctgaaactctcatgtgcgaggctctggattcactattcagtnactcggactatatacgtgggtccgcctagtcgtacggaccgggtaagggcgtgggaggtggcgttggccgtagttaacgaaacctaactagaacgtaagtacgacgtaactaatttatggactgcgtcggtagaccgtaaggcgtacggttaccaccgtacttccgtaccgaaggtacgtacgttacgtaacttacgtaaggaaccgaaaccgtaccgggtacgttacgtaccgtacggaacgtaaaacgttacggaaaccgtaacgtaacccgttaaaccgggaaaaacccgggtaacgggaacccggtaaccgggttccgttaacggtttaaccgttacgtaccgggtactaacccggtaacgaaccgttaccggttacccggttaccgtttaacgtttaacggttttacttttttaccggtacggtttacccgggttaacccgg

SEQ ID NO: 60061 - DNA, 753 bp, Homo sapiens
  misc_feature: GYAE6OF02I91SO.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctatttaaaaggtgtccagtgtcaggtgcagctggtggaggtccgggggaggcgttggtccgaggccgggggggtccctgaaactctcgatcgtgcaggctcgtggattcgactattcgagtgacgtcgcttatactactcggggtcccgccagtctggaccggggaaaggcgtggtagtggtcgttcgggaccgttagttaacggaacccaaaaccgttcggaaacctaaagggtaaccgtaccggaaaccgttaaattttacggtacggcgttacggtacgggttccgggttaggaccggtaaaacgggtccggttaacgggttaccctaacccgtaacgttacccgtacccgaaggtaaccgtagttacggtaagttacccgaaggtaaacgaacccggaaccggtacgtacttacgtacgaacgtaaagtacgaaactaccggtacctaacggaaaaccgtaacgggacccggaaaccgggtccgttacgttactttaacggtcggtccgaaccgaacgaccgtaccgttaccgttaccgtagttttacccgttagtttttacgtacggttccggttaacccg

SEQ ID NO: 60062 - DNA, 604 bp, Homo sapiens
  misc_feature: GYAE6OF02HUN9M.26.57.F02.1.454.CMB.1.raw
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (457)..(457): a, c, t, g, unknown or other
  misc_feature (457)..(457): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaagtgtccagtgtcaggtgcagctggtggaggtccgggggaggcttggtccaggcccggggggtccctgaactctcatgtgcaggtctcgtggtacttcactattcagtgactcggctatatactgggtcccncagtcgtgccgggaaggtcngggagtggctggcctattacgaaccaacgtgacaagtacgcgaacaatttangctgcgtaggtgacaggctacggttccaaccgatctcccgagagacgtgagttcgaagaagtaacgacggacgtacnctgactaaatagaacgacgccgtaacgaaaccgacgggaaccaccgggtacgtcgttacgtttacgtacggtcgaccgtaacgactacgttaccgttacggttacgtttaccgtttacgtttttacgttacggttacggttacccgg

SEQ ID NO: 60063 - DNA, 787 bp, Homo sapiens
  misc_feature: GYAE6OF02F2F0I.26.57.F02.1.454.CMB.1.raw
  modified_base (448)..(448): a, c, t, g, unknown or other
  misc_feature (448)..(448): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagcgtggtggaggtccgggggaggtcttggtccgagggcccgggggggtccctaggaaactctcatgtgcgaggctcgtggacttcactattcagttcgacgtcggactatacgtacgtcgggtcccgcgtagtccgtacgggtaccggggaaagggtccgtagggtacggtcggtcgtttcgggaccgttaacgttaaaccgaaacctaaaccgtggaaactaaacggtacgacggtaaactaagtttancgtctcggtacggttcgggtagaccggaaaggtccgtaacggtttaccacctaacgttccgtaaccgtaaggaacgtaatacggttaactacggtaaaggtaacggaaaccgtaccgggtaacgttacgttaccgtaacgtaacgtaaaagaccggtaaaccgtaaccgtaccggttaaaacccggaaaaaccgggaacggaaccgaacccggggttaccgttaacggttacttaccgtacggtcggaaaccgtaacgtaaccgttaaccgttacccggtttacgtaacgtttttaaccggtttaacgtttttaccgtaccgggtttcccgttaaccgg

SEQ ID NO: 60064 - DNA, 618 bp, Homo sapiens
  misc_feature: GYAE6OF02HH0EL.26.57.F02.1.454.CMB.1.raw
  modified_base (396)..(396): a, c, t, g, unknown or other
  misc_feature (396)..(396): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccgggggaggcttggtccgagggcccgggggggtccctggaaacctctcatgtgcaggctctggattcactattcagtgactcggctatatacgtgggtcccgccagtcgtggaccggggaagggctgggagtggcgttggccgttatacgaacccaactgaacaagtacgacgaactaatttangactgcgtcggtgactaaggcgtaggttcaccatcctccagagagtgtactacgaagaacgaaaccgcggtacgtactcgtacgactaaatacgaaacgacgtacccgaacgtaaaaccgacggaccgaccggtaccgtacgtacttacgtcgtcgacctaggacctaaccgttccgttacgttaactttaccgtttactttttacgaggttccgtacccgg

SEQ ID NO: 60065 - DNA, 715 bp, Homo sapiens
  misc_feature: GYAE6OF02FM6UZ.26.57.F02.1.454.CMB.1.raw
  modified_base (255)..(255): a, c, t, g, unknown or other
  misc_feature (255)..(255): n is a, c, g, or t
  modified_base (289)..(289): a, c, t, g, unknown or other
  misc_feature (289)..(289): n is a, c, g, or t
  modified_base (665)..(665): a, c, t, g, unknown or other
  misc_feature (665)..(665): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttcgtgtgctatttaaaggtgtccagtgtcaggtgcagctggtggagtccgggggaggcttggtccgaggccgggggggtccctggaaactctcatgtncaggctcgtggattcatattcagtgacctcggtntatatacgtggtccgccgaggtcctgggacccgggtaagggcgtgggtacggtggcgttagggtacccgttaagttaacgaaacccgtaaacgttacgaacgaaacggttaccgaccggaactaagttttataggtccgtcgtcggtcgggttacggccgaaagggccgtacgggtttacccaaccgttactacccgttaccggaagaacggtagttacggaacgtttaccagggaaacgaacggtacccgggtacggttacttcgtaacgacgttaaacaacgtacgaacccggttaacgtaacgggaaaaccgccggtaaccgtaaccgggtccgttacggttaacttccggtacgtaccggaccaacggtacnccggttaccggtactttacgttacgtttctttcgttaccggtgtaccccg

SEQ ID NO: 60066 - DNA, 661 bp, Homo sapiens
  misc_feature: GYAE6OF02I1UPI.26.57.F02.1.454.CMB.1.raw
  modified_base (461)..(461): a, c, t, g, unknown or other
  misc_feature (461)..(461): n is a, c, g, or t
  modified_base (655)..(655): a, c, t, g, unknown or other
  misc_feature (655)..(655): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaagatgtccagtgtcaggtgcagtcgtgggtggaggtccgggggtaggcgttcggtccgagggtcccggggggtccctaggaaacgtctactatgtcgcgtaggctctggtattcactattcgagtcgacgttcggacttataacttacgtcggggtacccaccgtaggttccgacgggaacccggggaaagggtcgtaggggtacggtcggcgtttcgggacccttaagttaaaccgaaaccgtaactacgaacgaacgtacgacgtaactaatttacgngtcgtgtcgtcggtacgacgacggacgtagtccaaccatctacgagagtactagtacgttagaaggaacgaacggaacgtctatacgtagaacgtaatacgaacgacgacgtaaacgaaacgacggaacgacgtacgtattacgtacgttgcaccgatacgtacgtcgtacgttacgttagtttacgtttacgngttccg

SEQ ID NO: 60067 - DNA, 801 bp, Homo sapiens
  misc_feature: GYAE6OF02GG7T2.26.57.F02.1.454.CMB.1.raw
  modified_base (360)..(360): a, c, t, g, unknown or other
  misc_feature (360)..(360): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggaggtccgggggagcttggtccaggccggggggtccctgaaactctacagtgtgcgaggtctcgtggtactcgacattcgagttgaccgtcggacttaatacgtacgtcggggtacccgcccgtaggtccgtacggaccggggaaaggggctagggngtgggtcgttcgggtccgttaagttaacgaaacccgtaaaccgtacgaaccgtaaacgtacggaccgtaaactaagtttaacgttcgtacgttagtccggttcgggtagtaccgaaacgggtcgtaacggtttaccaacccgtactcccgttaccggaacgtaaggtacgtacggtaactacgaacggaacgtaaaccgtacgggtaccgtttacgtaccgttaaggaaccttaaacggtaacgtaaacgaccggtaaccgtaaaccgggaaaacccggtaacgggtaaaccggtaccggggttaacccggttacggttaaccgtttaccggtacggtaccggtaaccgtaaccggtaaccgttaacggttacccggttacgttttaacgtttaacccgttttaacgttttttaccggaccgggtttacccggttacccgg

SEQ ID NO: 60068 - DNA, 898 bp, Homo sapiens
  misc_feature: GYAE6OF02HW55J.26.57.F02.1.454.CMB.1.raw
  modified_base (331)..(331): a, c, t, g, unknown or other
  misc_feature (331)..(331): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagcgttggttttcctgttgcttattttaaaggtgtccagtgtcaggtgcagcgtggtggaggtccgggggaggcgttggtccgacgggcccgggggggtccctaggaacctctcgatgtagcgaggtctcgtggacttcgactattcgagtcgacgtcggtactatagtcgtacgggtcccncacgtcgcggtaccgggaacggtccgtagggtacggtcgggtaccggtttcgggaccggttaaagttaccggaaaaccccgtaaaacccggtacggtaacccgaaaggtttaaccggacgtaaaacccttaaagttttacgtacggtaccgttacgggtaccggttaccggggttcgaaacgggtaacgggtacttaacggggttaccctaaaccgttaaccgttcccgttaacggtaacggtaaagggtaacttacgggttaaccttaccggaaagggaaaccggtaaacccggaaccggggtttaccgttaacgtaccggtaacggtaaccgtaaaaacggttaccggaaaccgtaacggtaaacccggttaaaccgggaaaaaccgttaaccggggaaaccggttaaccgggttacccggttaacgtttaacccgtttaacggttaccgttaacccgggtaacccgaacgttaaacccggttaccgtttacccggttaaccggtttaacgttttaaccggttttaacgttttttacccgacgggtttacccgtttaaccccggg

SEQ ID NO: 60069 - DNA, 679 bp, Homo sapiens
  misc_feature: GYAE6OF02FS8VL.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaggtgtccagtgtcaggtgcagctggtggaggtccgggggagcttcggtccaggccggggggtccctgaaactctcatgtgcaggctcgtggattcactattcagtcgactcggctatatacgtcgggtcccgccgtgtccgtcggaccggggaaagggctagggagtcgggacgtttcgggccgttagttacgaaccaaaccgtgaacgacgtacgcgaactaatttagtgtactgcggttcggtcgacgaagggctaggtccgtacacgtctaccgagacgtagtgtactacgtaagaacggaacgacggtacgttacgtcgtacgactaaacgtacgaacgtacgaccgttaaccggaaaccggtaaccggaaaccggtaccggaccgttagttacgtttacgtaggtccgacccgaacgtaacccgtacgttaccggtttaccggttaacctttaaccggtttacgttttttacggtaccggttaccggttaaccccgg

SEQ ID NO: 60070 - DNA, 761 bp, Homo sapiens
  misc_feature: GYAE6OF02JI20K.26.57.F02.1.454.CMB.1.raw
  modified_base (339)..(339): a, c, t, g, unknown or other
  misc_feature (339)..(339): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatgggagtttgggctgagctgggttttcttgtgcttatttaaaggtgtcagtgtcaggtgcagtctggtggaggtccgggggaggtcgttggtctgggcccgggggggtacctgtaaacgtctcgatcggtgacgaggtctcgtaggacttctaacatttcgaggttgacggtcgtacgttatacgtagtccgggtaccgtccgngttacgtcggaccggggtaaacgggtcgtagggtaccgttggggcgtttcgggacctaacgttaagaaacccgtaaacgtcgtacgaaggtaccggtacgtaaattaactttggcgtacgtacggtcggtacggttccggaaacggggtaccgtagttacccgtacacgttacgtccggaagtacgtaacgttgtaacgtccgaacggtaaacgtaccggtaacggtcgtaacgtacctacgggtaaactaggtaacgaaccgttagaaccgttaaccggaaacccgtggaaacccgaccggggttaacttacggaaacgttttaccggacgtaccgggaccttaacgggaccggtttaaccggtacccggttagtttttaacgaaccgttttaccgtttacggtacggttaccgtaaccgg

SEQ ID NO: 60071 - DNA, 641 bp, Homo sapiens
  misc_feature: GYAE6OF02GTXZ7.26.57.F02.1.454.CMB.1.raw
  modified_base (339)..(339): a, c, t, g, unknown or other
  misc_feature (339)..(339): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttccgtgtaggctatttaaagtgtccagtgtcaggtgcagctggtggagtccgggggagcgttggtccaggtccggggggtcctggaaactctcatgtgcgaggtctcgaggtattcactattcgagtgactcggctaagtaatcgtcggccgtcagttcgaggaccggaaggtcgtaggtgnggtcgttgtccgtaagtaaccgaaccgtaaactgtaacaaggtacgcgtaactaatttagacgtctacggtcgtcggtagacgaacggtcgtacgtccacgtactcgtccgtagacgtgtcgagttacagtaacgaacgacgtactagtactacgaacgtaatacgaaccgtacgaccgtaacggaaaccgacggaccgtacggtacgttacgttacgttacgtagtaccgtacgacgtaaccgtacgttccggtaacgttacgtttaccgtttacgttttacgtacggttccgttaaccgg

SEQ ID NO: 60072 - DNA, 681 bp, Homo sapiens
  misc_feature: GYAE6OF02HK1ZQ.26.57.F02.1.454.CMB.1.raw
tcagagactatactcacgaccggtgctcgatttagctcgatatagttgggtttgggggctgggagaggagctccagccttgggattcccagctgtctccactcggtgatcggcactgaatacagagactcaccatggagttgggctgagctgggttttccttgttgctattttaaaggtgtccagtgtcaggtgcgagctggtggaggtccgggggagcgttggtaccgaggtccgggggggtcctgaaacctctcagtgtgcaggctcgtgattcacgtattcgagtcgactcggccttaatactacgtcgggtccgtcctagtcgtacgggaccggggtaaaggcgtgggaggttcgacgttggaccgttagttaacgaaacctaacgtgactaaagtcgacgtaataactttgacgcgtacgtcggttacgggtcacggaacgtcgtacggtacacctacgtacctcctaggacgattagacgttagacggtaaagaccgtacggaccgttaagtccgtacgaacggtaactacggtaaacgtaccgaacggtaaccaaaaccgggtaccggaaacgtacccggtagttaccggttattaccggtgtaccgaccgtacgaacgtaccgttacgttacggttactttaccggttattttacggtacgttcgttaacccg

SEQ ID NO: 60073 - DNA, 625 bp, Homo sapiens
  misc_feature: GYAE6OF02IB4U1.26.57.F02.1.454.CMB.1.raw
  modified_base (195)..(195): a, c, t, g, unknown or other
  misc_feature (195)..(195): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtncagctggtggagtccgggggagcttggtcgaggccggggggtccctgaaactctcatgtgcaggctctggattcacattcgagtgtactcggatatatacgtgggtcccgccagtccgtggaccgggaaaggctgggagtggtcgtggccgtattaacgaaccgaactnaacgagtacncgaactaattangtctgcgtcggtgacgtaacggctacgggttacaccgtaatcctaccgtagacgtaagtacgtagttacgaacgtaacggtaaacgaacgggtcgtaactcgtaacgaactaaagtacgaacacgtaccgaacgtaaaccgacggacgaaccggacgttatacgttacgtacggtcgaccgagtaccgtacgtaccgttacgttaacttacgttacttttacgtacggtacgttacccg

SEQ ID NO: 60074 - DNA, 873 bp, Homo sapiens
  misc_feature: GYAE6OF02IY9KP.26.57.F02.1.454.CMB.1.raw
  modified_base (177)..(177): a, c, t, g, unknown or other
  misc_feature (177)..(177): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagctgggtttcctgtgtctattttaaaggngtccagtgtcaggtgcagctggtggagtccggggagctggtccaggccgggggtcctgaaactctcatgtgacgaggtctcgtggacttcgacgtacttcgagtcgacgtcgtactatactacgtcgggtccgacgtagtcgtaccggaccgggtaaacggtctacgggtaacggttcggaccggtttaccgggacccggtttaacgtaaaaccggtaaaccccgttaaaaccggtacggtaaacccgtaaaacggtttacccggaacggtaaccgtttaaaacgttttacgccgggttaacctcgggttaccggtaccgggttacgaacgtaaaccgggtcgttaaccgggttcctaaccgaacgtttcccgacggttaaggacgtacgtacggtaattccgaaacggtaacgtaaacggtaccgggttaacgttaccgttacgtaacgggaaaccctaaaggttacccgaacgaacccggttacccgtaaaaccggtaaaacccgggtacccggtaaaccgtaaccccggggttaacgtttaaccccggtaacgtttacccggtttacccggaaccggtaacccggtaaccgggttaaacccggttaacccgttacccgggtttaaccgtttaacgttttaaccccggtttacgtttttaaccggtaccgggtttaccccgtttaacccccggg

SEQ ID NO: 60075 - DNA, 710 bp, Homo sapiens
  misc_feature: GYAE6OF02GRPOA.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagctgggttttccttgttgctattttaaaaggtgtccagtgtcaggtgcagcgtggtggaggtccgggggagcgttggtccgagggcccgggggggtccctagaaactctcgatgtgcgaggtctcgtggtacttcactacttcgagtcgaccgtcggtactaagtacgtacgtcggggtcccgtacgtacgtccgtacgggtacccggggtaaaggtccggtagggtacggttcgggtaccggtttcgggtaccggttaacgttaacgaaaacccgtaaccgttagaaccgtaaacggtaccggacgaaactttaacttagtgtcgtcggacggttcggtacgacgtaacggtcgtacggttaccacgtcgtacccgtacgtagacgtatggtaacttacgaaggaccgaaacggcggttgtactcgtagaacgaagtaccgacacgtaccgaacgaaaccggacgaacgtccggtacgttagtacgttacgcggtcacgtacgacgtaccgttcggttaccgttagttaccgttttaactttcggtacggtcctaaccg

SEQ ID NO: 60076 - DNA, 629 bp, Homo sapiens
  misc_feature: GYAE6OF02GHENJ.26.57.F02.1.454.CMB.1.raw
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccgaggcccggggggtccctgaaactctcagtgtgcgaggctcgtggattcactattcagtgactcggctatatacgtgggtccgcgagtctcggaccgggaaagggcgtagggaggtggcgttcggcgttaattaacgaaaccaaccgtagaaccaaggtacgacgaactaatttatgcgtgcggtcgggtcgacgaaggcgtacggttccaaccntcgtaccgagagatagtatgaagganaacgcggtcgtagtcgtagacaaagacgaacaacgaccgtaacggaaaaccggacggaaccgaccgggtccgttagttacgttacgtaggtccgaccacgacctacgtttccgtacgtttacgttacgtttactttttacgtaggttaccggtacccg

SEQ ID NO: 60077 - DNA, 656 bp, Homo sapiens
  misc_feature: GYAE6OF02IK0ZC.26.57.F02.1.454.CMB.1.raw
  modified_base (248)..(248): a, c, t, g, unknown or other
  misc_feature (248)..(248): n is a, c, g, or t
  modified_base (417)..(417): a, c, t, g, unknown or other
  misc_feature (417)..(417): n is a, c, g, or t
  modified_base (465)..(465): a, c, t, g, unknown or other
  misc_feature (465)..(465): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtcgggggagcgttgtccaggccggggggtcctgaaactcncagtgtgcaggctcgtaggacttcacgattacagtcggactcggctaatactacggttggtcccgcctagtcgtacggaccggggaaagggctagggagtgggcttcgggtcgtaattaacggaaaccctaaaccgtacgaataaacgtaccgacgaaactaaattcgnggtacctgccgtacgggtcacgggtaacgtccgtacggttaccaaccnctacctaccgaagacgtagtagacttacgaagaacgtaacggaacggtacgtactacgtacgtaacaagtagaactacgacctaagaaaccgtacgaacgtaccggacgtgtattacgtgacggtaccaagtaacctacgttaccggtacgttactttaaccggttatttttaccgtacggtacgtacccg

SEQ ID NO: 60078 - DNA, 660 bp, Homo sapiens
  misc_feature: GYAE6OF02HFS6D.26.57.F02.1.454.CMB.1.raw
  modified_base (405)..(405): a, c, t, g, unknown or other
  misc_feature (405)..(405): n is a, c, g, or t
  modified_base (480)..(480): a, c, t, g, unknown or other
  misc_feature (480)..(480): n is a, c, g, or t
tcagagactatactcacgaccggtgctcgatttagctcgatatagttgggtttggggctgggagaggagctccagccttgggattcccagctgtcctccactcggtgatcggcactgaatacaagagactcaccatggagtttgggctgagcttgggttttccttgttgcttaattttaaaaggtgtccagtgtcaggtgcagctggtggaggtccgggggagcttggtccgaggccggggggtcccagaaactctcatgtgcaggctctggattcactattcagtgactcggctaatatacgtaggccgaccagtccgtacggaccggggaaaggcgttggagtggcgttggcgttaatacgaaaccaaaccgtgaacgaagtaccgacgtaactaaagtttanacggtctacggcggttacggtacggacgtaaagggcctaaggtccaactactacgtaccaagaagatgtaactanaacggaacgtaaacgacggtacgtaactacgtacgaacgaaacgtagaacgtaacgaccgtaaacgaaacgaacggaaccgacggttaccgtaatacgttagtacggtacaccgtaagacgtacgttacccgttacgttaacgtttaccgtttactttttacgtacggttcgttaacccg

SEQ ID NO: 60079 - DNA, 675 bp, Homo sapiens
  misc_feature: GYAE6OF02FMXLI.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcgttggtccaggccggggggtccctgaaactctcagtgtgcaggctctggattcacattcgagtcgactcggctatatacgtggtcccgtaccgacgtctaggaccgggaaagggtctgggagtcggtcttgggccgtaagttaacgaacctaaacgtgaacgtaacggtacgacgtaactaatttagtacgtaccggttgtccggtccgggtacgtacggaaggtcgtaacggttaccaaccctaagttccctaacccgaggtaacgaacgtagtacgtacgaacggtaaacgaccggtaacggtccggtaactccgtagaacccaaagtcggaacaacgtaccaacggaaaaccgaggtaccgacggtacgttacgttacgttacgtcggtcgaccaacggacttaccgtccgtacgttacgttaagtttacttttcgtacggttccgtacccgg

SEQ ID NO: 60080 - DNA, 783 bp, Homo sapiens
  misc_feature: GYAE6OF02H8WBW.26.57.F02.1.454.CMB.1.raw
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtaggtttgggctgagtcgtttgggtttttccttggttgtactttaagtttttaaaaggtcgttccgaggtgtcgaggtgacgagtcgttgggtcgggtacggggtccgggggagtcgttcggtaccgacggggtccccgggggggttccctaggaaacttctacgtagtcggtgcgtacggtctcgtagtacttcactnttcgagtcacgtcggtactatacgtacgtcgggcccncgtggtcgacgggacggggaaggngtcgggaggtcgggtcgttacgggtaccgttaaggttaacccgaacctaaaccgtggaaaccgtacggtacgaccgtaaattactttacgcgtcgtagcggttacggtagacgtaggtccgtacggttacccaaccgtacgttccaacggaagtagtaacgtacgttaacgtacgaaaggaaccgtaaccggtacgtacggtactacgtacgaacgtaaagtaacggaacctacggtaaccgaaccggtaaacgacggtaaaccggtaccggtacgttacgtttacggtaccttaggtaccaccggaacgtaccgttacgttacccgttaccggttttaacgtttacccggttttatttttaccggtaccggttaccgttacccgg

SEQ ID NO: 60081 - DNA, 764 bp, Homo sapiens
  misc_feature: GYAE6OF02GUSYK.26.57.F02.1.454.CMB.1.raw
  modified_base (475)..(475): a, c, t, g, unknown or other
  misc_feature (475)..(475): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaggtgtccagtgtcaggtgcagctggtgggaggtccgggggagtcgttggtccgagggtcccgggggggtccctaggaaacctcctcgagtggtggcctaggcttacgtggtatcactattcaggtcgtacctcggacttacgtataccgtcggggtacccgccgtacgtcggtccggaacccggggaaaggtcggtcggaagggttcgggtacttcgggcccggttaagttaaccgaaaacccgtaaaccgttcggaaacgtaaacgggtaccgtaccgaaacgtttaaagttacngtacgtcggtaccggttcgggtgtaccgaacgggtcgtaacggtccgtaacctagtacccgtcgaagtgagtagtactacgagaacgaaccggtagtacggacttcgacgaacctaaagtacgtaaacgacgtaacccgtaaacgggaaaaccgacggtaaaccgaacccgggttaccgttacgttaacgtttaccggtaccgtacggtaccgaaacgtccgtaaccgtttaccggttaacggttacgtttaccgtttacgttttaccgtaagggttcccgttaaccgg

SEQ ID NO: 60082 - DNA, 843 bp, Homo sapiens
  misc_feature: GYAE6OF02IF9Q3.26.57.F02.1.454.CMB.1.raw
  modified_base (295)..(295): a, c, t, g, unknown or other
  misc_feature (295)..(295): n is a, c, g, or t
  modified_base (787)..(787): a, c, t, g, unknown or other
  misc_feature (787)..(787): n is a, c, g, or t
tcagagactatactcacgaccggtgctcgatttagctcgatatagttgggtttggggctgggagaggagctccagccttgggattcccagctgtctccacgtcggtcgaccggcactgaatacaagagactcaccatggtagtttgggctgagcttcgggtttttccttgttgacttaatttttaaaaggtgtacctagtgtcaggtgcagcgtggtaggacgggtccgggggaggtcgttcggtccgacgggtcccgggggggttaccctaggaaacctttcacgtaattcggngccgaggtccttcgtacggtaacttccgaacgtacgtttacgacggttacgtaaccgtccggtaacttaattaacgttaccggtcgggtcccgacccgtaagttcccggtagggtaaccgggggtaaacggtcggtagggtaacggttcgggtccgttttacgggacccggttttaagttaaaccccggtaaaaccctaaaaccggttacggtaaacgtaaaccgggttacgaccccggtaaaactttaaagttttacggtacggtacgttacggtaaccggttccggttaggaccgtaaaccgggtacgttaacgggtttaacccaacccgtaaccgttacccgttaccgtaactaaggttaacgttacgtaaccgtttacggaaaggtaccggaaaaccgtacgggtaaccgttaacgttaaccgtggaaactacgaacgtaacgacgtacgtaaacgaacgacgacgtacgcgtacgttagtactcganccgtagacgtacgttccgtagttacgttcttagtttacgtacgttccgtactacgg

SEQ ID NO: 60083 - DNA, 856 bp, Homo sapiens
  misc_feature: GYAE6OF02FP7F6.26.57.F02.1.454.CMB.1.raw
tcagagactatactcacgaccggtgctcgatttagctcgatatagttgggtttggggcgtgggagaggagctccagccttgggattcccagctgtctccactcggtgatcggcactgaatacaagagactcaccatggagtttgggctgagctgggttttccttgttgctattttaaaggtgtccagtgtcaggtgcagctggtggagtccgggggagcttggtccaggccggggggtccctggaaacctcgtcatgtgcgaggctcgtggattcgactaactttcaagttcgaacctcgggacctattacgtacgttcgggtaccccgccgtaagtccgttcgggacccggggtaaaacggggtccgttacggggtaacgggttcgggtaccggttttcggggaccccggttttaaacggttttaaaccggaaaaccccgttaaaaccccggttcggaaaaccggtaaaccgggttaaccgggtaccgttaaacgtaaccgtttttaaagtccgggtaaccgttccgggtccgggttttacggggtaccgtaaccgggtaaaacgggtcccgttaacggggtttaacccctaaacccggtaacctttacccggttaaccccggaaggtaaccggtaaggttaccggttaacgtttacccgaaaggtaacggaaacccgtaccgggtacgttaacgtacgttacgtaacgtaaacgtacggaaccgtaaccgtacgtaacgggaaaaccgaacggtaaccgtacccggtacggtagttacgttacggtacgtcgaccgaacgtaccgtacgttaccgttacttacggttaccttagttttcgacggttcgtacccg

SEQ ID NO: 60084 - DNA, 933 bp, Homo sapiens
  misc_feature: GYAE6OF02H1LD2.26.57.F02.1.454.CMB.1.raw
  modified_base (232)..(232): a, c, t, g, unknown or other
  misc_feature (232)..(232): n is a, c, g, or t
  modified_base (368)..(368): a, c, t, g, unknown or other
  misc_feature (368)..(368): n is a, c, g, or t
  modified_base (550)..(550): a, c, t, g, unknown or other
  misc_feature (550)..(550): n is a, c, g, or t
tcagagactatactcacgaccggtgctcgatttagctcgatatagttgggtttggggctgggagaggagctccagccgttgggacttcccagctgtctccacgtcggtgactcggcactagaatacgaagagacctacactagtggtaggtttcggcttaggtacgttcgtttcgggttttccttggttacgttaacgtttaaaggtttaacgtcgtacgtagttggtacgnggtcgacggtggtggtcggggtagggtacggggtcgggccggttacggttcggggtaccgggtccggggttacccgggtacctaaccgtacgtcacgtacggtcggtcgtacgtacggtcggttactagtttaccncttaacgtccgtagggtacctacgttacggtactaacgttaccggttaccggtccgggttaccgaccggtacgggttaccgggtagggggaaccgggggtacggggtaacgttccgggtacggtttacggttaccggttaccgtaaccggttaaacgtaaacccgaaacctaacggtaaacncggtaaacctaccggtaaacgtactaggtttacgggcgttacggtccgggttaacggtacgtaccgtaacggggttacgtaccgttacgttaacccgtaccaccggtaacgaaccgttagttaaccggtaacgtaaccggttaacggtaaacgtaaccggaaccgttaccggaaaccggttactaacggttaacgtaccggaaaccgttaaacgaaacccggtaccggtaaaaccgacgggttaaaccggaaccgggtaaacctccgggtaaacttcgtaaccgtttgaccgtaccgtaacggtaccggtaaccttcggttacccgttaacgtttaacggttgttttacgggttcctaaggttcccgtacggtagtaaccggg

SEQ ID NO: 60085 - DNA, 745 bp, Homo sapiens
  misc_feature: GYAE6OF02IBL53.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaagtgtccagtgtcagtgcagctggtggagtccgggggagcttggtccaggccggggggtccctggaactctcactgtgcaggctctggattcacattcagtgactcggctatatacgtggtcccgccagtctggaccggggaaagggtcgtgggaggtggtccgttgggccgttaagttacggaaaccaaaccgttaggaacctaagtacggaccgaacgtaaattttacgacggtcgtagccgttcgggtacgaccgaacgggtcgtacgggttcctaccgtactaccgtacctacgagtaagtagaactttcgaagaacgaacgaacggtacgtacgtacgtacgactaaacgttacgaacgtacgtaacccgtaacgggaaaaacccgtacgggtaaaccgaacccggggtaaccgttacgttaaccgtttaccgttaaccgggttcggtaaccccgtaacggtaacccggttaacccgttaccccggtttaccggtttaaaccgttttaacccggttttaacgttttttttacccgggtaacggttttaccgggtttaacccccgg

SEQ ID NO: 60086 - DNA, 748 bp, Homo sapiens
  misc_feature: GYAE6OF02FWC4E.26.57.F02.1.454.CMB.1.raw
  modified_base (270)..(270): a, c, t, g, unknown or other
  misc_feature (270)..(270): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctattttaaaaggtgtccagtgtcaggtgcagctggtggagtccgggggagcttggtccaggccggggggtccctgaaactctcagtcgtgcaggtctctggtnttcactattcgagtgacgtcggcttatactacgtcgggtccgccgagtccgtgggacccggggaaagggccgtagggagttgggcgtttcgggaccggttaattaccgaaacctaaaccgtgacgaaagttaccgacgacgttaaatttacgtcgacgtaggtccgggttacgggtacgaccggtaaagggcccgttacgggtttaccaccggtaccttaccgtccgaaggtaacgatacgtaacttacggaacggtaacgaaaccggtacgggtaccgttacgtactacgtaacaacgtaacgaaaccgacgggtaccgaaaccggtaaaaccgggaccggaaaccgggaccgggttacccgttaacggttactttccggtacgtaccgaaccgtaacggtaccgtacgttaacccgggtttaccttaaccggtttagttttaccggtttttactaccgggtttccggttaacccgg

SEQ ID NO: 60087 - DNA, 694 bp, Homo sapiens
  misc_feature: GYAE6OF02IZJDV.26.57.F02.1.454.CMB.1.raw
  modified_base (521)..(521): a, c, t, g, unknown or other
  misc_feature (521)..(521): n is a, c, g, or t
  modified_base (681)..(681): a, c, t, g, unknown or other
  misc_feature (681)..(681): n is a, c, g, or t
tcagagactatactcacgaccggtgctcgatttagctcgatatagttgggtttgggcgtgggagaggagctccagccttgggattcccagctgtctccactcggtgatcggcactgaatacaagagactcaccatggtagttgggctgagtcgtggttccgttcgttgctatttaaaaggtgtccagtgtctaggtgcagctggtgaggtccggggagcgtggtcgacggtcggggggtccctagaaacgtcgtaccgtatgtcggcgacgtcttacgtggtacttaccgactacttacgtagtcgacgtcgacttaactacgtacgtacgggtccggcctaacggtctcggaccgggaacggtcgtggacgtcggcgttcggtaccggtattaaccggaaccgaaacgtacgtaacgtaacgtaccggcgtaacgtaactttagtcgtaacgtcgacgttcgtacggaacgacggtacgtaccggtacctaacggtacgtccgttacgaacgtaggtacngttactacgaaggaacgtaagtaccggtactagttaccgtagtaccgaagttaacgaccgttaacgcccgtaaagaaccggaacggtacgaccgtacgtagttacgacgtagtcccgagtaaccgactaccgtacgtacgttacgttacgttaccgtttntacgtccttacgg

SEQ ID NO: 60088 - DNA, 851 bp, Homo sapiens
  misc_feature: GYAE6OF02IRZJU.26.57.F02.1.454.CMB.1.raw
  modified_base (272)..(272): a, c, t, g, unknown or other
  misc_feature (272)..(272): n is a, c, g, or t
tcagagactatactcacgaccggtgctcgatttagctcgatatagttgggtttgggggcgtgggaggaggagctccagccttgggattcccagctgtctccactcggtgatcggcactgaatacaagagactcaccatggagtttgggctgagctgggtttccttgttgctatttaaaggtgtccagtgtcaggtgcagcgtggtggaggtccgggggaggtcgttgggtccgaggccggggggggtccctaggaaactccgtcatggtcgngaggcgttcgtgggattcactattccgaggttacgaccgtcgggtctaatagtaccgttcggggtcccgccgtacggtccgtcggaccggggaaaaggggtccgtaggggacggttgggtccggtttacgggccccggttaagtttaaccgggaaaacccctaaaacccggttacgggaaacccgtaaaaacggtttaccgggaccggtaaaccttaaaacggtttttaacgttcggtccgttaggtcccggggtttaccggggtaggtaacccgtaagggggaccgttaacgggtttacccgaaacccgttaacgttacccggtaccccgtaaggtaaacgaacgttggtaacgtttacccgaaggttaacgaaaccgttaaccggttaaccggtacgttaccgtaacggtaactaaacgtaacgtaaaaccggtacgtaacccgttaacggaaaacccgggacggtaaaccggaccggtaccggttagtacttacggtacgtcggtaccacggtaactcgtaccggttcgttaaccgtttacgttaacgtttttaccgtacgttacggttaacccgg

SEQ ID NO: 60089 - DNA, 684 bp, Homo sapiens
  misc_feature: GYAE6OF02GN31G.26.57.F02.1.454.CMB.1.raw
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (259)..(259): a, c, t, g, unknown or other
  misc_feature (259)..(259): n is a, c, g, or t
tcagagactatactcacgaccggtgctcgatttagctcgatatagttgggtttggggctgggagaggagctccagccttgggattcccagctgtctccactcggtgatcggcactgaatacaagacgactcaccatggagtttgggctgagcgtggtttctgtagctatttaaagtgtcagtgtcaggtncngctggtgagtcggggagcgttggtccaggccggggggtcctgaaacgtctcatgtgcgagctgtggnttacactattcagtgacgtgtctatagtacgtcgggtccgcacgttctggaacccggggtaaaggtccgtgggacgtcgggtcgttcgggtaccggttaagttaaccgaaaccctaaacccggttagaaccgtaaaggttaccggaccgtaacttaaagttttaccgtagtcggttcggtcggttcgggttacgaacgtaaacgggtccgtaacggtttcccgacgtaactcgttacccgagtaacgagtaacgtcttacgaagttaacgaccgtaacggtcgttaacgtcgtacgaacgtaaagtacgaaactacgtacgtaacggaaaccgtacggacgaccggtcgtagttacttacgtgtccgtacgtagaccgtaagtccgtacgttacgttacgttaacgttttcgacgttcgtaccgg

SEQ ID NO: 60090 - DNA, 801 bp, Homo sapiens
  misc_feature: GYAE6OF02FVS5A.26.57.F02.1.454.CMB.1.raw
  modified_base (721)..(721): a, c, t, g, unknown or other
  misc_feature (721)..(721): n is a, c, g, or t
tcagagactatactcacgaccggtgctcgatttagctcgatataggttgggtttggggctgggagaggagctccgagccttgggattcccagctgtcgtccactcggtgatcggcactgaatacaagacgactcgacctagtgggtaggtttgggctggtagtcgttgggtttttcccttaggttagtacttaacgttttaaaaggtcgttacccgtaggttcgtacgtaggttcgcctaggtcgtagggtcggtacggggtccgggggacgtcgttacgggtcccggacggggtcccgggggtcctacgtaaacgtctagtagttggtcgacgtaggtctcgtggtactacaaggtatcgtacgtacgtccgtcgtacttagtacgttacgtccggtaccgcgtacggtcggtacgggaaccgggtacggtcgtagggtcggtcggttcgtacggtaccgttaacgtaaccgaccgtaacgtacgaacgtacggtaccgtactaacttacgttagtacggcgtacggtcgtacggtacgacggtacgtacgtaccgtaccactacgtacttacggaagtaccgtagtaaccgttaggaccgaacgtaacggtaccggttacgtccggttaactaacggtacgaactaagggaccgtaaccgacggtaaacggaacggtaaccgaacgtaccggttagtacgttacgtacgtaggtacccncgtaccggttattacccggtttagttaccgtttaccgtttaacgtttacccggttattcccgggtacgtggttaaaccgg

SEQ ID NO: 60091 - DNA, 718 bp, Homo sapiens
  misc_feature: GYAE6OF02FHRKX.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttgggtccgaggcccgggggggtccctggaaacctctcatgtgcgaggctcgtggacttcactattcagttgactcggctatatacgtcgggtccgccagtctggccgggaaagggcgtgggagtcggtcgttcgggaccgttagttaacggaaaccctaaaccgtgaaccgaacggtaccggccgtaactaatttacgtgcgtaggtcggttcgggtgacgaacgggtcgtaacgggtttccaacctacttacccgtaccgaaggaacgtagttagtattaccgaaggtaacggaaaccgtacgggtacgttacgtacgtacgaacgtaaagtacgaaacgacgtaccgtaaacggaaaacccggtacggaaccggtaccgggtaccggttacgttacgttacgtcggtacggaccgaacggtaccgtaccgttaccggttacggtttaacgtttaaccgttttacgtttttcggtacggttcccggttacccgg

SEQ ID NO: 60092 - DNA, 799 bp, Homo sapiens
  misc_feature: GYAE6OF02FINWY.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccgggggggtccctggaaactctcgatgtgcaggctctggattcacattcagtgacctcggctatactactcgggtcccgcctagtctcggaccggggtaaaagggcgtagggtacggttcgggtacgtttcgggacccggttaagtttaacggaaacccgtaaaacccgtacggtaaccgaaaggttaaccggaccggaacctaaacgttttaacgtacggtaccttacggtccggttaccgggtacggaccgtaaagggtaccgtaacgggtttaccaacccgtacgtccgtaaccccgaacggtaacggtaacgttaggtaacgttacgaacggtaaacggtaaaccgaacgggtaccgttaactccgttacgaacgtaaaacgtacggtaaaccaacgggtaacccgtaaacggaaaacccgggtaacggaacccggaaccgggtacccggttaggttaacttacgtacggttaccgaccgaacggtaaccgttaccgtacccggttacggttaacgtttaacccgtttaagttttttaccgtacggtttaccgggttaccccg

SEQ ID NO: 60093 - DNA, 802 bp, Homo sapiens
  misc_feature: GYAE6OF02G7GO7.26.57.F02.1.454.CMB.1.raw
  modified_base (316)..(316): a, c, t, g, unknown or other
  misc_feature (316)..(316): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccgaggcccgggggggtccctggaaactctcatgtgcaggctcgtggattcactatcagtcgactcggtctatatacgtcgggtcccnccgagtctcgggaccggggaaagggcgtgggaggtcgggtcgttgggtccgttaagttaaccggaaaccctaaaccgtgaaacgaacggtacgacgtaaactaatttacgtcggactggtccggtcgggtacgacggtaacgggtaccgtaacgggtttacccaacccgttaacgttacccgtacccgaacgggtaacgtaacgttacgtaacgtttacgaaacggtaaacggtaacccggtaaccgggtacgttaacgttaccggtacgtaaaccgtaaaacgttacgaaaccgtaccgtaacccgtaaacgggtaaaaacccggaacggggtaaacccggaccggggtaccgttaggtttaaccgtttacgggttacggtacccgtaaccggaacggtaaccgttaccggttaacccggttacggtttaacgttttaaccgttttaacgttttttaccgttaccgggttacccgttaacccggg

SEQ ID NO: 60094 - DNA, 752 bp, Homo sapiens
  misc_feature: GYAE6OF02GZ9QB.26.57.F02.1.454.CMB.1.raw
  modified_base (311)..(311): a, c, t, g, unknown or other
  misc_feature (311)..(311): n is a, c, g, or t
  modified_base (401)..(401): a, c, t, g, unknown or other
  misc_feature (401)..(401): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtgggaggtccgggggaggcttggtccgaggcccgggggggtccctgaaactctcatgtgcaggctctggattcacattcagtgactcggctatatacgtgggtcccncagtcgtcggccggggaaaggcgtaggaggtggcgttggaccgttataacgaaaccaaacctgacaaggtacgacgaacgtaatttacgngtacgtcgtacggtcggtgacgtaaacgggtcgtaacggtttaccaacccgtacgttaccctacccgtaagtaaccggtaattacggtaaactttcgaaacggtaaacggtaaaccgtaacgggtaccgttaaacttccggttaacgtaacgtaaaacgttaacggaaaccgtaaccgtaaccgttaaaccgggaaaaacccggtaaggaaacccggtaaccgggacccgttagttacgttacgttacggttccgaccgtaacggtaaccgtaaccgttacccggttaccgtttaaccggtttaaccgtttaccggtttttttaccgtacggtttacccggttaaccccgg

SEQ ID NO: 60095 - DNA, 780 bp, Homo sapiens
  misc_feature: GYAE6OF02IVCZ4.26.57.F02.1.454.CMB.1.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgcttaattttaaaaggtgtccagtgtcgaggtgcagctgggtggaggtccgggggaggtcgttggtccgagggccggggggtcctgaactctcngtgngcaggctcgtggactcactattcgagtgacgtcggactattacgtacgtcgggtcccgccgtacggtccgtcgggaccggggtaaacgggcgtagggaggttcgggtcgttacgggtaccgttacgttaacgaaacccgtaaacgtggaaaccgaacgtacgaccgtaacttaaagtttactaggtctcggtcggtcggtacgacggtaaacgggtccgtaacgggtttaccacccgtaactcccgtaccgtaaggtacgtagtacggttaacgttaccggtaaggtaacggaaccggtaacgggtaccgttaacgtaccgacgtaacgtaaacgtaacgtaaccgtaacgtaacccgtaacggaaaacccgggacggtaaacccggtaaccgggtaacccgggttaggtttaccgttaacgtcggtacgtaccgtaaacgtaccgtacgttacccggttacgtttaacgtttaccgtttacgtttttaccggtacggttacccggtaaccgg

SEQ ID NO: 60096 - DNA, 784 bp, Homo sapiens
  misc_feature: GYAE6OF02IBZBR.26.57.F02.1.454.CMB.1.raw
  modified_base (278)..(278): a, c, t, g, unknown or other
  misc_feature (278)..(278): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctaattttaaaaggtgtccagtgtcaggtgcagctggtggaggtccgggggagcttggccgaggcccggggggtccctagaactctcatgtgcaggctctggtattcactnttcagtgactcggtactatacgtacgtcgggtcccgcgtaggtccgtacggaccggggaaagggccgtagggacgtgggtccgttcggaccgttaagtaacgaaaccccaaactcggaaactaacggtaccgacgtaactaaacgttttagcggtacgttacgaccgggttacgggtacgaaccgggtaaacgggtccgttaacgggtttaacccaaccgtaaccgttaccgttaaccccgtaaggtaaacggtagttaacggttaacgtttaaccgaacgggtaaaccggtaaacggtaaccggtaccggtttaacgtccgttaacgaacgaaacgtaacggaaaccgtaaccggaaccgtaaaccgggaaaaccgggaacggtaacccgtaaccgggtaccgttacgttacttacgtcggttaccgaaccgtaacgtaacgtaccgttaccgttacgttacgtttaaaccggtttctttttaccggtacggttccgttaacccg

SEQ ID NO: 60097 - DNA, 773 bp, Homo sapiens
  misc_feature: GYAE6OF02G28LF.26.57.F02.1.454.CMB.1.raw
  modified_base (343)..(343): a, c, t, g, unknown or other
  misc_feature (343)..(343): n is a, c, g, or t
tcagagactatactcacgaccggtgctcgatttagctcgatatagttgggtttggggctgggagaggagctcccagccttgggattcccagctgtctccactcggtgatcgacactgaatacaagagactcaccatggagtttgggctgagcgttgggttttccttgttgcttaattttaaaaggtgtccagtgtcaggtgcagctgggtgggagggtccggggggaggtcgttgggtccgacgggtcccggggggggtcccctaggtaaacctctcagtggtgcgaggctcgtggtacttcaactattcgagtgacgtcggactatattacgtcgggtcccnccgtagtcgcgggaccggggaaggcgtgggacggttggtcgtttgggtacccgttagttaaccggtaaaaccctaaaccgtcgaaccgtaaaggtacccggacgaacttaaacgtttacgtacggtcgttcggtaccggggtcggtacggacgtaaacgggtcgtaaccgggttacctaacccgtacgttacccgtaccgaaggtagtaacgttacggtaacttacgaaacggaacgtaaaccggtaacggtacgttaccgttcgtaacgtaacctaaaagtaccgaaaccgtaccgaaaccgtaacggaaaacccggacggaccgaacccggtacgtaagttaccttacgtagtaccgccgtaagaccgttacgttaccggttaccgttaacgtttacgttaacgtttttacgacggttccgtaaccgg

SEQ ID NO: 60098 - DNA, 681 bp, Homo sapiens
  misc_feature: GYAE6OF02HVWNL.26.57.F02.1.454.CMB.1.raw
  modified_base (332)..(332): a, c, t, g, unknown or other
  misc_feature (332)..(332): n is a, c, g, or t
tcagagactatactcacgaccggtgctcgatttagctcgatatagttgggtttggggctgggagaggagctccagccttgggattcccagctgtctccactcggtgatcgacactgaatacaagagactcaccatggagtttgggctgagcgttgggttttccttgttgcttaattttaaaaggtgtccagtgtcaggtgcagctggtgggaggtccgggggaggcgttggtccgagggcccgggggggttccctagaaactctcgagtgtgcaggctcgtggtattccgaactattcgagtcgtacgtcggactatatacgtcgggtcccncgacgttcgtcggaccggggaaggcgtggaggtggtcgttggccgttaattaacgaaaccctaaaccgtagaaccgtaaacggtaccgacgtaactaaattttacgcgcgttcgcggttcggtgacgaaggtcgtacgtacctaccactccgtaccgaagagtagtagtactacgagaacgaacgacggtacgtatcgtacgaactaaagtacgaacgacgtacctaacggaaaccgaacggaaccgaccggtacgtagttacgttacgtcggtacgaaccgacgtaacgtcgtaccggttacgttaacgtttaccgtttacgtttttacgtacggttccggtacccgg

SEQ ID NO: 60099 - DNA, 1000 bp, Homo sapiens
  misc_feature: GYAE6OF02HR5JU.26.57.F02.1.454.CMB.1.raw
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaggtgtccagtgtcaggtgcagctgggtggacggtccggggggaggctttgggtccgagggtcccgggggggtccctgaaacttctcatgtcgcgaggcttcgtaggtactttcaacgttattccgtaaggttcggtaccgttccgggtacttaacgttaacgttaaccggttccgggggttacccccgtaccccggtacggtttaccggttaccgggggaacccgggggggtaaaaaccgggggtaccggttggggggtaacgggttacggggtaccgtttttacgggggaccccggtttaaaagtttaaaccggtaaaaaccccgtaaaacccgttacggaaaacccggtaaaccgggtttaaccggaaccggtttaaaccttaaaacgtttttaacggtaccggttaccgttaccgggttcgggttttaccggggtacggtaaccggaacggggttacccgttaacgggttaccctacccggttaacctttcccgtaaccgtaaacggaacggttaacgtttacggtaagtttaaccgggaaggaaaccggttaaaccggaccggggttacgttaaccgttccgtaacgggtaaacctaaaaccgggttaacgaaacccgtacggtaaaaccccgtaaccgggaaaaacccggtaacccgggtaaacccggaaccgggttacccggtttaacgtttaaccggtttccgttaacggtcccggtaacccgaacggttaacccttacgtttacccggttaaccgttttaacggttttaaccggttttaacctttttaccgggttacgttaccggtttacccgg

SEQ ID NO: 60100 - DNA, 740 bp, Homo sapiens
  misc_feature: GYAE6OF02JKJOA.26.57.F02.1.454.CMB.1.raw
  modified_base (383)..(383): a, c, t, g, unknown or other
  misc_feature (383)..(383): n is a, c, g, or t
  modified_base (464)..(464): a, c, t, g, unknown or other
  misc_feature (464)..(464): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgtcttaattttaaaaggtgtacctagtgtcgaggtgacagtcgttgggtgggacgggttccggggggaggtcgtttcgggtcccggacgggtccccggggggggttcctacggtaaacctccgtcgagttcgtgcgtaggccttcgtaggacttacactacttacgagtcgtacgtcggtacttagtactacggttccggtccgccgagtccgnggaccgggaaggcgtgggagtggtctggcgttaactaacgaacctaaccgagaacgaacgtacgacgaacctaagttttancggtacgtcgtacggtcgggtacgacggaacggtcggtaccgttaccgaaccgtacttaccgtacgagtacgtagtacgtacgttagaaggaacggtaaccgtacggtacgttacgtccgtacggaaactaaggtaccgtaacgaaccgtaaccggtaaaccgtaaccggaacgaccggtaccggtacgttacttacgttacgtcgtaccgtacgtactacgtaaccgttgttaccttaacgttccgttttaagttttccgacggttccgttaccg

SEQ ID NO: 60101 - DNA, 539 bp, Homo sapiens
  misc_feature: GYAE6OF02JFV7G.26.57.F02.1.454.CMB.1.raw
  modified_base (374)..(374): a, c, t, g, unknown or other
  misc_feature (374)..(374): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttgggtccagccgggggggtccctgaaactctcatgtgcaggctctggattcacattcagtgactcggctatatactgggtccgcagtctggccgggaaaggctggagtggcttggccgtatagaaccaaacctgacaagtacgcgacaattangctgcgtcggtgcaaggcaggtcacatctacagagatagattcagagaacacgcgtatctagcaaatacgaacagacctacgaaaccgacggaacgacggtacgtgtatacgtagtgaccagaacacgtaccgtacgttacttacgtattttacagttcgtaccg

SEQ ID NO: 60102 - DNA, 653 bp, Homo sapiens
  misc_feature: GYAE6OF02FLS9O.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcttggtccgaggccgggggggtcctggaaactctcatgtgcaggctcgtggattcactattcagtgactcggctatagtacgtcgggtccgccagtcgtcggaccgggaaagggcgtgggaggtggcgttcgggtccgttaagttacggaaaaccctaaaaccgtggaactaaacggtaccggacgtaactaaagtttatcgcgtggcggttacgggtcgacgaacgggtcgtacggttcaccgtatcctacgagtagatgtatacgagaacgacgacggacgtactcgtagactaaatacgaacgacgtaccgtaacggaaaaccgaggaaccgaaccggtaccgtagttacgttacgtggtacgaccgacggactaccgttaccgttacgttaacgttacgtttacgtttttacgtacggttccggtaccg

SEQ ID NO: 60103 - DNA, 722 bp, Homo sapiens
  misc_feature: GYAE6OF02F959Q.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagttgggctgagctgggtttccttgttgctattttaaaaggtgtccagtgtcaggtgcagctggtgggtaggtccgggggaggtcgttgggtccgacgggcccgggggggtccctaggaaactcctcatgtgcgaggccgtcgtggacttcactattcagtcgactcggctatactacgtcgggtcccgcgtacgtcgtcggaccgggaagggcgtggacggtggtcgttggccgttaagttaacgaaccctaaaccgtagaacgaaggtaccgacgtaactaaacgtttagtcgtcgtggtaccggtcggtacgacggaacggtcgtacggttaccgacctactacccgtacgtaggtaacgtagtacgtacttaccgaacggtaacgaaacggtacgggtaccgttaacgtaccgtacggaaactaaacggttaacgaaaccgtaacgaacccgttaaacgggaaaaccgtacggaaaccggtaccgggaccgtttacggtacgttacgtcggtacgaccgtacggtaactacggttccgtacgttactttacggtttacttttacgtacgttccggtacccg

SEQ ID NO: 60104 - DNA, 837 bp, Homo sapiens
  misc_feature: GYAE6OF02IJNGH.26.57.F02.1.454.CMB.1.raw
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctaattttaaaggtgtccagtgtcaggtgcagctgggtggaggtccgggggagtcgttgggtccgagggcccgggggggtccctaggtaaacctcgtcagtggtcgcgaggtctcgtggtacttcgactagttccgaggtgaccgtcggtacttaagtagttaccggttcgggtaccccgtcctacggttccgtcgggacccggggtaaaggccgtgggtacggtcggtacggttaggaccggttaaacttaacggaaaccccgttaaaactaccggtaaaccgtaaacggtaccggtaaccgtaaacgtttaaacgttttacggcgtacgtacgggttaccgttccgggtacgaacgggtaaacggtaccggtacgggtttacccaaccgttaaccgtacccgtaccgtaacgggtaaacgtacgttacggtaacttaccggaaaggttaacggaaacccgggttacggtaacccggttagtccggtaacggtaacttaaaacggtacgaaaccgtaccggtaaccggtaaaccggtaaaaccgggtacgggaaccgtaccgggtacggttacgttacggttaacggttccggaacaccggtaaacgtacgtaccgttaccggttacgttacggtttacgttaacgttttcgaccggttacgtaccgg

SEQ ID NO: 60105 - DNA, 700 bp, Homo sapiens
  misc_feature: GYAE6OF02JPCG6.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttagttttaaaggtgtccagtgtcaggtgcagctgggtggaggtccgggggagcgttggtccgagggccggggggtccctaggaaactcgtcatgtgcgaggtctctggacttcgactattcagtcgacgtcggatagtatacgtcggtcccgacacggtcgtacggacccggggaaaggtcgagggtaggtggtaccggttgggtaccgtacgttaacggaaacccctaaacgtacggtaaaccgaaaggttacccggacgtaaaccttaaagtttacgtggttacctggtaccgggttcggtaggtaccggaacggtcctaacgggttaccaccacgtttcccaccgtaggaacgtatcggaagttacgagaaccgtacgacggtaccgtatccgtacaagtaatacgagaacgaccgtaacgaaaccgaggacgtaccgggagttcgtaagttaccgtgacgtaaccgataaccaccgtttaccggatttaaccgtagttttaccttttcgtaccggttgtaacccgg

SEQ ID NO: 60106 - DNA, 716 bp, Homo sapiens
  misc_feature: GYAE6OF02I2A52.26.57.F02.1.454.CMB.1.raw
  modified_base (267)..(267): a, c, t, g, unknown or other
  misc_feature (267)..(267): n is a, c, g, or t
tcagagactatactcacgaccggtgctcgatttagctcgatatagttgggtttggggctgggagaggagctcccagccttgggattcccagctgtctccactcggtgatcggcactgaatacaagagactcaccatggagtttggctgagcttgggttttccttgttgctaattttaaaaggtgtccagtgtcaggtgcgagctggtggaggtccgggggaggtcgttggtccgagggcccggggggtccctggaaacctcgtacgngtgtgcgtaggctcgtggacttacacctattccgagtcgacctcggtacttaatactacgttgggtcccgcgacggttccgacgggaccggggaagggtccgtggaggtcggtcgttcggcgtaagttaacgaaccgtaaacctagaaccgaaagtacgacgtaacttaagttatacgtgtcggtacgtcggtacgacgtaaggtcgacggttcaccgtacgtaccgtacgtagagtatgtagtcgaagacgaaccgacggtccgttacgtacgtacgaacgtaataaggaaccgtaccggtaccgtaaacggaaaccgtaaggaaccgtaccgggtaaccgttacgttacgttcgttaacgggcgtaacccgtaaggtacccgtaacgttcccgtttaacgttacggttttaccgtttaagttttttccgtacgggtttccgtaccgg

SEQ ID NO: 60107 - DNA, 751 bp, Homo sapiens
  misc_feature: GYAE6OF02FMSC1.26.57.F02.1.454.CMB.1.raw
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggtttttccttgttgcttattttaaaaggtgtccagtgtcaggtgcagctggtggaggtccgggggaggctttgggtcccgagggccgggggggtccctgtaaacctccgtcatgtgcaggctctgattcacattcagtgcgtcgntatatcgtgggtccncctagtctggaccggggaaagggcgtgggaggtggtcgttcgggccgttaagttacgaaccaaacgtgaactaaggtacgaccgtaactaatttacgtgcgtggaccggttcgggtcgacgaacgggtcgtacgggttactacccgtacttccgtaccgaggtacgtagttacgtaactttcgaaggtaacgaaaccggaaccggtacgtacgttcgtaaggtaacgtaaagtaaggaaacctacggtaaaccgtaaccgggaaaacccgggaacggtaaccgaacccggggtaccggtttaacgtttacgttaacgttacgggtaaccgtaacccgaaccggtaaccgttaccgtttaaccccggtttacgtttaaccggttttaaccggtttttaaccgtttttttaccggacgggtttcccggttaaccccgg

SEQ ID NO: 60108 - DNA, 851 bp, Homo sapiens
  misc_feature: GYAE6OF02HA93E.26.57.F02.1.454.CMB.1.raw
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctatttaaaggtgtccagtgtcaggtgcagctggtggaggtccgggggagcgtggtccgaggccggggggtccctgaactctcatgtncgagctcgtggacttcactattcgagtcgactcggnttaatntacgtcgggtccgcctacggtctgggtaccggggaaagggtcgtacgggtagtcgggtctttcggggtccggttaacgttaaacggaaaccctaaaaccgtacgtaaaccggtaaacggtaccggtaccggtaaacttaaagtttttataaccgggtctcgggttaccgggttaccgggtaggtaccgtaacggggtaccggtacggtttaacccaccggttaaacttcccgttaccggaaacggtaacgtacgtaacggttacgttaacgaaccgggttaaaacggaaccgttaaccgggtacttaacgttaccgtaacgaaccgttaaaacgttaaccgggaaccgtaaaccggtaacccggttaaacgggaaaaacccggtacgggaaacccgtaaccgggttacccggtttaacggtttaaccgtttaccggtagggttaacccgtacccggtaacgttacccgttaacccggtttaaccgttaccggtttttaacctttaccggttttaacgtttttacggttaccgggtttaccccggttaacccggg

SEQ ID NO: 60109 - DNA, 661 bp, Homo sapiens
  misc_feature: GYAE6OF02H0HZK.26.57.F02.1.454.CMB.1.raw
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (491)..(491): a, c, t, g, unknown or other
  misc_feature (491)..(491): n is a, c, g, or t
tcagagactatactcacgaccggtgctcgatttagctcgatatagttgggtttggggctgggagaggagctccagcccttgggattcccagctgtctccactcggtgatcggcactgaatacaagagactcaccatggagtttgggctgagctggttttcctgttgcttattttaaaaggtgtccagtgtcaggtgcagctgggtggagtccgggggagcgttcggtccgaggcccggggggtccctgtaaacctcgtacatcgtgcgaggtcctcgtggtacttacgactattcgagtcgacgttcggcttagtatacgtcgggtcccgcacgttctggacccgggaaaggtccgtggaggtggtccgttggtccgttaattacggaaaacctaaaccgttcgaaccgaaggtacccgagtaaccttaaattacngtacgtcgcgttcggtanaccgaaggtccgagttcgacctacgtctaccgagaanactagtatacgaagtaacgaaccgtacggtactacgtcgtacgacaaagtacgaacgtaccgaacgtaacgaaacggaaccgacgtaaccgtcgtattaacgttcgtagtcgtacagtaactaccgtccgtagttacgtttagtttacgttttacgtacgtacgtacccg

SEQ ID NO: 60110 - DNA, 682 bp, Homo sapiens
  misc_feature: GYAE6OF02GK3OV.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctatttaaaaggtgtccagtgtcaggtgcagctggtggagtccgggggaggcttggtccaggccggggggtccctgaaactctcatgtgcaggctcgtggtattcactattcagtgacgtcggctatatacgtcgggtcccgccgagtctcggaccggggaaagggtcgtcgggaggtggcgttcgggtccgtagttaacgaaacctaaaccgtgaacgaagtaccggacgtaacgtaattttaacgtacgtccgtaggccggttcgggtacggacgaacgggtacgtacgggttaccgacccttaacgtcccgttaacgaaggtacgtaagttggtaactacgaagaacggtaaccgacgggtaccgtagtcctaggaactaaagtacgaaccgagtacccgtaagaaaccgaacggaccgaccggtaccgtagtacgttacgtacggtacgaccgaacgtactaccgttaccgtacgttacttaccgttacgttttctacggtttccgtacccg

SEQ ID NO: 60111 - DNA, 728 bp, Homo sapiens
  misc_feature: GYAE6OF02F4LWA.26.57.F02.1.454.CMB.1.raw
  modified_base (274)..(274): a, c, t, g, unknown or other
  misc_feature (274)..(274): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccgaggccggggggtccctgaaactctcatgtgcaggctctggatcgacnttcagtgactcggtctatatacgtcgggttccgcctaggtcgtagggaccggggtaaagggccgtagggaggtcgggtccgttagggccggttagttaacggaaacctaaaccgtaggaaccaaggttacgacgtaaccgtaatttacgtacgcgtacgtaccggttcgggtagtaccggaaggtccgtacggttaccgacctacgttccgtaccgtaagaacgtacgtacgtaacttacgaaggaaccgtaacgtaaccgggtacgtaacgttaccgtagaacgtaaacgtaagtaaccgaagtacccggtaaacgaaaaccgggtaacggaaccgtaacggtaccggtaggttacttacggtcggtaaccggtacgtaaccgtacgtaccgttacccggttacggtttacgttaaccgtttagtttttaccggtaggttacccgttaaccgg

SEQ ID NO: 60112 - DNA, 616 bp, Homo sapiens
  misc_feature: GYAE6OF02IRT33.26.57.F02.1.454.CMB.1.raw
  modified_base (304)..(304): a, c, t, g, unknown or other
  misc_feature (304)..(304): n is a, c, g, or t
  modified_base (381)..(381): a, c, t, g, unknown or other
  misc_feature (381)..(381): n is a, c, g, or t
  modified_base (436)..(436): a, c, t, g, unknown or other
  misc_feature (436)..(436): n is a, c, g, or t
tcagagactatactcacgaccggtgctcgatttagctcgatatagttgggtttggggctggggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccggggggtccctgaaactctcatgtgcaggctctggattcacattcagtgactcggctatatactgggtccnccagtctgaccggggaaagctggagtggcttggccgtattagaaccaaactgaacaagtacgacgaactaatttagngacgtgacgtcggtgaccgaaggcgtaggttcaccatctaccagacgatgtattnagagaacacggacgtactcgtagacaaatacgaacacgtaccgtaacggaaaaccgtaacggaaccgaaccggaccgttacgttacgttaccgttacggtacggaccgacggtaaccgtacgtacccggttacgttacgtttaacgttacgttttttaccgtaggttccggttaacccgg

SEQ ID NO: 60113 - DNA, 588 bp, Homo sapiens
  misc_feature: GYAE6OF02FX2A0.26.57.F02.1.454.CMB.1.raw
  modified_base (388)..(388): a, c, t, g, unknown or other
  misc_feature (388)..(388): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggccggggggtccctgaaactctcatgtgcaggctctggattcacattcagtgactcggctatatacgtgggtccgccagtctggccgggaaagggctaggagtggcttgggccgtagttacgaaccaaaccgtgaacaagtacgcgaactaagtttangactgcgtcggtgacgaaggcgaggtcaccatctaccagagagtagtactacagaacgaacgacgacgtactctagacaaatacgaacacgccgtaacgaaacgaacgaccgacgggtccgtagttacgtacgtcgtcgaccacgtactacgtaccgttacgtacgtttaccgttatttttacgtacgttcggttacccg

SEQ ID NO: 60114 - DNA, 688 bp, Homo sapiens
  misc_feature: GYAE6OF02GC2EY.26.57.F02.1.454.CMB.1.raw
  modified_base (512)..(512): a, c, t, g, unknown or other
  misc_feature (512)..(512): n is a, c, g, or t
  modified_base (621)..(621): a, c, t, g, unknown or other
  misc_feature (621)..(621): n is a, c, g, or t
tcagagactatactcacgaccggtgctcgatttagctcgatatagttgggtttggggtctgggagaggagctccagccttgggattcccagctgtctccactcggtgatcggcactgaatacaagagactcaccatggagttgggctgagctgggttttccttgttgcttattttaaaggtgtccagtgtcaggtgcagctggtggacggtcgggggaggcttgggtcccgagggccggggggtccctagaaacctcgtactagtcgtgcgaggtccgtagtggtattccactagttcaacgtcgactcggctattagtacgttgggcccgccgacgtcggtaccggaccggggaaagggtcgtacgggtagtcgggtcggtttcgggaccgttagttaaaccggaaacccgtaaccgttacgaaacgtaacggtacggaacgaacgtttaaatttagtacgtcgtcgtcggttccggagtacgaacgggtctacggttacacctagtaccnccgtagaagtcgtaggtactacgagtaacggacacggtatactcgtaggactaacgtagaccgtacacgtaacaacgggacgaacgtacgtaccgtagttacgttacgnggtacccacgtacgaccacgttacgtacgttacgttaccgttacgtttagtaccggttcgtacccgg

SEQ ID NO: 60115 - DNA, 738 bp, Homo sapiens
  misc_feature: GYAE6OF02HKCVZ.26.57.F02.1.454.CMB.1.raw
  modified_base (360)..(360): a, c, t, g, unknown or other
  misc_feature (360)..(360): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtcctagtgtcaggtgcagctggtggaggtccgggggagcgttggtcgagggccggggggtcctaggaaactctcatggtagcgaggtctcgtggtatcacattcagtgactcggactatacgtacgtcgggtacccgcgtacgtcggtcggaccggggtaaacggtccgtagggnggttcggtcgtttagggaccccttaagttaaccgaaacccctaaacgtacgaacgtaaacgtacgtacgaacgtttaatttacgacgtcgtacgtcggttcggagaccgtaacggtcgtacggtccaacgtacttcgtacgagtaacgtacgtgtaacgttacgaacggaacgtaccgaacggttaccgtacgttaccgtgaaacgtaacgttaaggaaccgtaacgtaaccggtaaaccgaaaccgggaacggaaaccggtaccgggtaccgttagttaccttacggtaccggttacgaccgttaacggacttacccggttacgtaccggtttaacgttaaccgttttaccgttttacgtccggttaccgttaccgg

SEQ ID NO: 60116 - DNA, 790 bp, Homo sapiens
  misc_feature: GYAE6OF02IKAMW.26.57.F02.1.454.CMB.1.raw
tcagagactatactcacgaccggtgctcgatttagctcgatatagttggggttggggctgggagacggagctccagccttgggattcccagctgtctcccactcggtgatcgacactgaatacgaagagactcaccagtcggtagtttggctggagcgttgggttttccttgttgacgttaagttttaaacggtcgtcctagtgtcgtaggtgcagcgtggtagggacggtccggggggaggtcgtttagggtccgaggggccccgggggggttaccctggaaaccgtcgtcgagtggtcgcgacggtcctcgtaggtacttcctacgtagttacgagttacgtaaccgtcggtacttaattacgtacgttacgggtcccgacgtggtccgtacggggacccggggtaacggcgtagggtaggttcgggtccgttcgggtaccggttaagtaacggtaaaaccctaaaccgtagaaccgtaaacggttaacgacgttaaagtttaacgttacgtgtccgttcggtccggttagggtccgaacggtaacgggtccgtaaccggttccgaaccgtacgtacctacggaaggtacgtaggtcgtaagttccggaaggtacgaaaccgacggttacgtaaccgtcgaacgtaacaaacggtacacggtacgtaccggtaaacgaaccggagaccgtaccgggtcttaggtacttcggtcgtaacgaccaggtaaccctcggttaccggttacgtaaggttttaccgtttacgtttacgtaggttcccggtaacg

SEQ ID NO: 60117 - DNA, 763 bp, Homo sapiens
  misc_feature: GYAE6OF02I5YDK.26.57.F02.1.454.CMB.1.raw
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgctattttaaaggtgtcagtgtcaggtgcagctggtggaggtccgggggaggtcgttgggtccaggccgggggggtccctaggaaactctacatggtcgcgaggtctctggattcactatcagtnacgtcggatatactacgtcgggtccnccgagttcgtacggcccggggaaagggtcgtacggaggtcgggtccgttcgggtcccggttaagtttaacggaaaccctaaaacccgtacggaaaccgaaacggttaacggaccgtaaaccttaaagtttacgtagtaccgttggtaccggtcgggtcgtaccgaagggtacgtacggttaccacctacttaccgtaccgtaacgtacgacgttagtacttacgaaggtaacgtaacgaaccgggtacgtaacgttacgaacgtaacaaacgttaacgaaaccgaacgtaacccggtaacggaaaaccgtaacgggaacccgtaacgggtaccgttaacgttacgttaacgttacggtcggtaaccctaacggtaacccttacgttacccggttacgttaacgtttaacgtttacgttttttaccggtacggttccggttaacccgg

SEQ ID NO: 60118 - DNA, 858 bp, Homo sapiens
  misc_feature: GYAE6OF02FEQZV.26.57.F02.1.454.CMB.1.raw
  modified_base (629)..(629): a, c, t, g, unknown or other
  misc_feature (629)..(629): n is a, c, g, or t
tcagagactatactcacgaccggtgctcgatttagctcgatatagttgggtttggggctgggagaggagctccagccttgggattcccagctgtctccactcggtgatcggcactgaactacaagagactcaccagtggtacgtttgggctggagtcttgggttttccttgttgtacttaagttttaaaaggtcgtaccaaggttcgtacgaggtgcgtagtcgtgggtggtacgggtccggggagtccgttcggtccggacgggtccgggggtacctagtaaccgtctctagtcgcgtcgtaggtacgtgtacgtactctactagtacgtagtaccgtacgtcgtacttacgttacgttaccggtccggttacccgacgttacggtacggtacgggaaccgggtaaggtcggttagggtacgttcggtacgtttacgggaccttaaacgtaaccgaaccgttaacgtcgtaaaccgtacgtaccgagttaaccttaagttcgagtcgttacgggtcggtacggtacggtaccgtaacggtccgtaccgttacaaccgtttaccgaccgtttaaccggaagttaccgtaagtaccgttaacgacggtaaaccggtacgtaaaccgggtnttaacccggttaagtaccgtaaccgtaaacgtaccggtaaacgacccgggttaaaccgttaaaccggaaaccgggaaaaccgggtcctacggggttaaacccgttacgggtttaactttaccgaccggtacggttaaacccgtacttaaccgggtaacccttttacgggtaccggttttaaccttttaacgttaccgttttttacgtaccggacggttcccgtaaccgg

SEQ ID NO: 60119 - DNA, 1032 bp, Homo sapiens
  misc_feature: GYAE6OF02H3WRI.26.57.F02.1.454.CMB.1.raw
  modified_base (322)..(322): a, c, t, g, unknown or other
  misc_feature (322)..(322): n is a, c, g, or t
tcagagactatactcacgaccggtgctcgatttagctcgatatagttgggtttgggggctggggagaggagctccagccttgggattccccagctgtctccactcggtgatcggcactgaatacaagagactcaccatggaggtttgggctgagcgttgggttttccttgttgcttaattttaaaaggtgtccagtgtcgaggtgcagctggtgggaggtccggggggagtccgtttagggtccgtacgggtaccggggggggtcccctaggaaaaccttccttcgattggtagaccgaggtcttcgtggtaacttccactnttacgaagtgtaccgtcgggacttaatagtaaccgtgggtccccgacctaggtccgtacgggtaacccgggggtaaaaggggtcgtaggggacggggtttacgggtccggtttaggggtaacccggttaacgtttaaaccggtaaaaaaccccctaaaaacccggtttaacggaaaacccggttaaaccgggtaaaaccgggttaaccggtaaaaaccgttttaaaaacgtttttaaccggtttacgggtaaccggtttcgggaccccgggggttttaacgggggttaaaacccgggtttaccccgggaaaaacccgggggtttaacccgggtttaaacccgggggtttaaaccctaaaccccccgtttaaaacccgggttttaccccgttaaaccccgggaaaacggttaaacgggtaaaccgtttacgggttaaacccggttttaaccgaaaccggggttaaaacgggtaaacccggtaacccgggttaaccgtttaaccgttacgtaaccgggttaaacctaaaaccggtaacggtaaaccgaaccgttaaacccggtaaaaccggtaaaaacccgacccgggaaaaccggtaccgggtacgttaacgtttacgttaaccgtaggttaccggaccgtaacggaacgtaccgttccggtacgtttaacgtttaactttaccggttttaacgtacggttaccgtacccg

SEQ ID NO: 60120 - DNA, 765 bp, Homo sapiens
  misc_feature: GYAE6OF02H5XWG.26.57.F02.1.454.CMB.1.raw
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttggctgagcgttgggttttccttgttgcttatttaaaaggtgtcagtgtcagtgcagctggtggaggtccgggggagtcgttggtccagggtcccggggggtaccctaggtaaactcgtacgatcggtgacgaggtccgtgtggaacttcgaacctaagttcaacggtgtaaccgtcgggtacctaatagtacgtcgggtacccgccgtagttccgnggacccgggaaacgggtcgttagggnggtacggtcgtcggaccttagttaaacgaaaccgtaaacgtacggaacaaacgtaccgagtaacttaaactttgcgtacgtcggtacgtacgggttcgaacgaggtaccgtaggtacctaaccgtaacttccgtacccgtaaggacgtacgtaacgtagttacgaaggaacgaaaccggtaccggaccgttaagttacctcgaacgttaaaacgtacgaaacgaacccgtacggttaaacccggaaaaccggtaaccggaaacccggtaaccggaccgttaggtaaccttaggtacgtccgtaaccgaccgtaaccgtaacgttaccgtacggttaactttaacccggttagtttttaacccgttaggtccccggttaaccg

SEQ ID NO: 60121 - DNA, 789 bp, Homo sapiens
  misc_feature: GYAE6OF02FLJWO.26.57.F02.1.454.CMB.1.raw
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtccgaggccggggggtccctgaaactctcatgngcgaggctctggtacttcactattcaggtgactcggactatagtacgtcgggtcccnccgagtcgtcggaccggggtaaagggtccgtagggacggttcgggtcgtttcgggtccgttaagttaacgaaacccgtaaaaccgttcggaaaccgtaaaggtaaccggacgaaacttaatttaatgtccgtaggtccggttcgggtcgaccgaacgggtacgtaacgggttaccaaccctacgtcccgtaccgtaaaggtagtacgttgtacttaccgaacggaaacggaaacccggtaaccgggtaccgttaactccggtaacggtaacctaaaaggttaccgtaaaaccgacgtaacccgtaaacgggtaaaaaccccgggaacgggtaaccgtaaccgggtaccggttaaccgtttaacgtttacgttacggtaaccggtacccgaacgccgttaacccgttcccgtttaacggtttaacgttttaaccggttttacgttttttaacgtaccggttccggttaacccgg

SEQ ID NO: 60122 - DNA, 685 bp, Homo sapiens
  misc_feature: GYAE6OF02IERDZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctggtgggaggtccgggggaggtcttggtcgacgggcccgggggggttccctaggaaacctctcgagtgtgcaggcttcgtggtattcacgtattcgagtgactcggctatatacgtggtcccgccgtagtctcgggaccgggaaaggcgtgggagtggtcgttggccgttaagttaacgaaacctaaaccgtgaaccgaaagttaccggacgtaactaaagttttagagcgttgccggttcgggtcgacgaacggtcgtacggttccacctactcgtaccaagtagtatagagttacgaagtaacgaaacgcggtactactacgtagactaaagtacgtacaggacctaacggaaaccgaggtaaccgtaacgggaccgttagtacgttcgtacggtcgaaccgtaacgtaccgttaacgttacccgttacgttacgttttaaccgtttacgttttttaccgtaccggtttacgtaacccgg

SEQ ID NO: 60123 - DNA, 789 bp, Homo sapiens
  misc_feature: GYAE6OF02FPYE4.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggtcttgggtcccagggtcccgggggggtccctggaaacctctcatgtgcaggctcgtggattcacattcagtgactcggctatactacgtgggtcccgcctagtctcgggaccgggaaaggcgtggagtggcttggccgttatacgaacctaaccgtgaacaggtacgcgtaactatttagcgtctgccgtcggtagaccgaagggtcgtacgggtttacaacctacttccctacccgagtaacggacttacggtaacttaccggaaggaaaccggtaaaccggaacccggggttacggttaacttacccgttacgggtaacctaaaaaacggtttacgggaaaaccgttaaccgggtaacccgttaaacggggtaaaaaaccccgggaaaccgggtaaacccggaacccggggttaacccggttaggtttaaccgtttaccgttacgggtaccgtaaccccggtaaacggtaacccgttaacgttaccccgggttttaacgttaaccggtttttaaacccggttttagtttttttaccccggttacggggtttaccggttaacccccgg

SEQ ID NO: 60124 - DNA, 760 bp, Homo sapiens
  misc_feature: GYAE6OF02HCZNB.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggaggtttgggctgagcgttgggtttttccttgttgtcttattttaaaaggttgtcctagtgttcgaggtgcagcgtgggtggaggtccgggggaggcgttggtccgacgggccgggggggtccctggaaactctcagtgtgcaggctgtgtacttcgacattcagtgtaccgtcggacttagtacgtacggtacgggtcccgccgtagttacgtacggggaccggggtaaagggtcggttagggacgggttggtccggttgggtacccggttaagttaaccggaaaacccgtaaaccgttacggaaaccgtaaacggtaaccggtaccgtaacttaaagttttactcggtaccgtacgggtccggtacgggtacgaccgaagggtcccgtacgggttacacccgtacgttaccctacgaaacgtcgaacgttaggtaacttaaccggaaggtaaccggtaacgaccggtagttacgtacgtacaacgtaaagtaacgtaacgaccgtaccgtaaacgggaaacctaggggaacccttacgggcgtttagtacgttcgtacggtccgactacggtacgtccgttacgttacgtttactacgtttacttttcggacgttaccgtcg

SEQ ID NO: 60125 - DNA, 610 bp, Homo sapiens
  misc_feature: GYAE6OF02F31GO.26.57.F02.1.454.CMB.1.raw
tcagagactatactcacgaccggtgctcgatttagctcgatatagttgggtttggggctggggagaggagctccagccttgggattcccagctgtctccactcggtgatcggcactgaatacaagagactcaccatggagtttgggctgagctgggttttcctgttgctattttaaaaggtgtccagtgtcaggtgcagctggtggaggtccggggggaggcttgggtccaggccgggggggtccctgaactctcatgtgcaggctcgtggattcacattcagtgactcggctatatacgtgggtccgccagtctggaccgggaagggcgtggagtggcttggcgttagttacgaaccaactgaacaagtacgacgactaatttatgctgcgtcggtgacgaagggctaggttcacctatcctaccgagagtagtagactcgaggaagaaccgacggtacgtactcgtagacaaagtacgaacacgtaccgtaacgaaaccgacggaccgaccgggtaccgtagttacgttacgtcggtacgaccgagtaacctacgttacccgtacgttacgtttaccgtttactttttacgtaggttccggttacccg

SEQ ID NO: 60126 - DNA, 716 bp, Homo sapiens
  misc_feature: GYAE6OF02FSOHJ.26.57.F02.1.454.CMB.1.raw
  modified_base (487)..(487): a, c, t, g, unknown or other
  misc_feature (487)..(487): n is a, c, g, or t
tcagagactatactcacgaccggtgctcgatttagctcgatatagttgggtttggggctgggagaggagctccagccttgggattcccagctgtctcccactcggtgatcggcactgaatacaagagactcaccatggagtttgggctgagctgggttttccttgttgctattttaaaaggtgtccagtgtcaggtgcagctgggtggaggtccgggggagtcgttggtcccgagggcccgggggggtccctaggaaacctcctcagtgtgcaggctcgtggtactcactattcagtcactcggactatatacgttcgggtccgcctagtccgtaggacccgggaaaggcgtggaggtgcgttggccgttagtacgaaacctaacctcgaactaacgtacgacgtaactaagtttagtcgactggcggttcggagacgaacggtccgtacggtttaccacctactaccctcgagagtactgtactanaggaaacaccgtacggtacgttactcgtacgtaaacaaagtacgaacctaacggtacccggtaaagaaaacccggtacggaacccggtaccgggtaccgtttagttacgttaccggttcggtaaccgtacccgtaaacgtacccgtaaccgtttacccgggttacgttttaaaccgggtttaacccgttttacgtttttacccgggttacgtacccgggttaaccccgg

SEQ ID NO: 60127 - DNA, 706 bp, Homo sapiens
  misc_feature: GYAE6OF02FWTTE.26.57.F02.1.454.CMB.1.raw
  modified_base (233)..(233): a, c, t, g, unknown or other
  misc_feature (233)..(233): n is a, c, g, or t
  modified_base (432)..(432): a, c, t, g, unknown or other
  misc_feature (432)..(432): n is a, c, g, or t
  modified_base (455)..(455): a, c, t, g, unknown or other
  misc_feature (455)..(455): n is a, c, g, or t
tcagagactatactcacgaccggtgctcgatttagctcgatatagttgggtttggggcgtgggagaggagctccagccttgggattcccagctgtcctcccactcggtgacgtcgggcacctgaatacaacgtagacctccaccatcggaggtttggctggagcggtcgttacgtcgtaaggcctagttaaacgtcgctacgtcgtcaggtgcagtgcgtaggagtcgggacngttcgaccacggttccggggacctgaaacgtcgtacagttcgacgtccgtaagtcgttcgtagtactacacgtagtcgaacgttcgacctcgctaacgtctacggccggtcacgtagtcgacggttaccgaagcgtaacgtaggtcggtcgttacggaccttagtaaccggtaacaaccgtggtacctaagggttaccnccgggaactttaagtcggtaacnccgtcgtacgacggtaccacgtacggtctacgtcgtacgtacgtacgtacgtacgtacgtacgtacgttacgtacgacgtaacgacgtacgtacgtacgtacgtacgtactacggactacgtaccgtaacgtaacgtaaccgtaacgtaaccgtacgtacgtaccgtacggtacgtacgtcgtaccgtaccgttacgaccgtttacgtaccgtttaaccgttacgttaccgtacgtacccggttacgtacg

SEQ ID NO: 60128 - DNA, 658 bp, Homo sapiens
  misc_feature: GYAE6OF02FQPDC.26.57.F02.1.454.CMB.1.raw
  modified_base (395)..(395): a, c, t, g, unknown or other
  misc_feature (395)..(395): n is a, c, g, or t
tcagagactatactcacgaccggtgctcgatttagctcgatatagttgggtttggggtctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccgaggccgggggggtccctgaaactctcatgtgcaggctcgtggattcacgattcagtgactcggctatatacgtgggtcccgcgagtcgtggaccgggaaagggcgtgggagtgggcgttggccgtagttacgaacctaaacctgaacgaacgtacgacgactattangctggcgtggtgacgaaggcgaggttcacctatcctacgagacgatgtacttacgagaacgaacgacgggtacgtagtctgactaaagtacgaaaccgtacgtaaccgtaacggaaaacccgggacggaaacccggaccgggtaccggttacgtaacgtttaccgtacggttccgaaccgtacgaaccgttacgttacccggttagtttaccgtttaaccggttttacgttttttaccggaacggtttccgggttaacccccg

SEQ ID NO: 60129 - DNA, 769 bp, Homo sapiens
  misc_feature: GYAE6OF02FTEW6.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggtttccttgttgctattttaaaaggtgtccagtgtcaggtgcagctgggtggaggtccggggggaggcgttgggtcccgacgggacccggggggggtcccctacggtaaacctcctcgagtcggtgcgaggctcgtggattcactattcagttgacgtcggtcttaatactacgtgggtcccgaccgtaggtcgtcgggaccggggaaagggtcgtagggacgtacgggcgtttgggacccgttaagttaacggaaaacccaaaaccgtacggaaacgtaaacgttaaccggacgaacgttaaagttttaactagtcgtacgtccggtcgggtacggaccgaaagggccgtaacggttaccgaaccgtactaccgtaccgaaggacgtagttacgtacttaccgtaaggaaacgtaacgaaccgggtcgtaacgttacgtacggtaacgtaaacgtaacgaaccgtacggtaaccgtaacgaaaaccggaacgggtaaacccgaacgggtaccggttacgttaacgttaacgtcggtacggacccgaacggtaacctacgttacccgtacggtttaccgttaacgttacgtttttacgtaccggtttcgtaacccg

SEQ ID NO: 60130 - DNA, 828 bp, Homo sapiens
  misc_feature: GYAE6OF02HRS3A.26.57.F02.1.454.CMB.1.raw
  modified_base (596)..(596): a, c, t, g, unknown or other
  misc_feature (596)..(596): n is a, c, g, or t
tcagagactatactcacgaccggtgctcgatttagctcgatatagttgggtttggggctgggagaggagctccagccttgggattcccagctgtctccactcggtgatcggcactagaatacaagagactcacatggagtttggctgagtcgttggtttttccttgttgtacttaagttttaaaaggtgtccgaggttcgtcgaggtcgacagcgttgggtgggagggttaccggggggacgtcgtttcgggaccgaggggtcccgggggggttacccttacggaaaccttccgtacgtagttggtacgccgagggtccttacgtaggtactttccgacttaagttcgtagttcgacgtccggtacttagtacttacggtccggacccgctacgttccgtacgggaccgggaaggccgtaggaccggttggtccgttacggtaccgtaaacgttaacgaaacccgttaacgacgtaaacgtaaacgtacggtacaaactttaagtttagtccgtacgttaggaccggtacggtacgacgtaacgggtaccttaacggttaccaaccggtacttccggaacgtaacggtaacggttnttacgttaacgtaccgaaaggtaaaaccgacgaacggttaccttagtctacgaaaccgttaaagttaaaccggaacaacccggaaacggttaaccgaaacggttaaccgggaacccgtaaccgggacgtttaccgttacgttagttcggaaccgtaccgaaccttagtaacccggtcctttaacgtttacgggtttactttttaacggtttaccttacggtcccttaaacgg

SEQ ID NO: 60131 - DNA, 674 bp, Homo sapiens
  misc_feature: GYAE6OF02JV0S6.26.57.F02.1.454.CMB.1.raw
  modified_base (329)..(329): a, c, t, g, unknown or other
  misc_feature (329)..(329): n is a, c, g, or t
  modified_base (623)..(623): a, c, t, g, unknown or other
  misc_feature (623)..(623): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgtcttaagttttaaaaggtgtccgagtgtcgaggtgcagcgtggtaggtacggtccgggggaggtcgttcggtccgacgggtcccggggggtcccgtagtaaacgttcgtcgacgttcgtgaccgtggtccttcgtaggtatttaccaacgtagttacgnggttcgaaccgtcgtacttagtacgtacggtccggtcccgacgtacgtcgtaggtacgggaaggcgtaggacgtggtcgttaggtacgtagtaacgaaaccgtaacgagaacgtacggacacgtaactaattgtacgtcgtcggacgttggtacgacggtagacgtacggtacaccgtagtccgacgagtacgtagtaccgtatacgaagaacgtacgacgttcgtagacgtagaacaagacgtacaacgtacgtaaacgaaacggacgtacgacgtactgtacttagaccggntacgtacaacgtctacgttacttacgtccgtttagtttcctagtacctcgg

SEQ ID NO: 60132 - DNA, 602 bp, Homo sapiens
  misc_feature: GYAE6OF02FYAB5.26.57.F02.1.454.CMB.1.raw
  modified_base (306)..(306): a, c, t, g, unknown or other
  misc_feature (306)..(306): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
  modified_base (483)..(483): a, c, t, g, unknown or other
  misc_feature (483)..(483): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgttgctatttaaaggtgtccagtgtcaggtgcagctggtggagtccgggggaggcgttggtccaggccgggggggtccctgaactctcatgtgcgagctctggatcgacattcagtgactcggctatatactgggtcccgccgngtctggaccgggaaaggctggagtggcgttggccgttatacgaaccaaacctgacaagtacgcaacattangcngcgtcggtnacgaaggtcaggtcaccatcctcaganatgtatcgagacgaacgacggtactactcgtacgacgaaatgaacacgtaaccgtacggaaaaccgnggaaccgtaccggaccggttacgttacttaacggtcgtcggacccgtaacgaccgacttacccggttacgtttaacgtttaacggtttactttttacggtaccggttaggttaccccgg

SEQ ID NO: 60133 - DNA, 616 bp, Homo sapiens
  misc_feature: GYAE6OF02HMQMF.26.57.F02.1.454.CMB.1.raw
  modified_base (312)..(312): a, c, t, g, unknown or other
  misc_feature (312)..(312): n is a, c, g, or t
  modified_base (393)..(393): a, c, t, g, unknown or other
  misc_feature (393)..(393): n is a, c, g, or t
  modified_base (600)..(600): a, c, t, g, unknown or other
  misc_feature (600)..(600): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggtctcgtggattcactattcaagtgactcggtctatatacgtcgggtcccncgagtcgtggaccgggaaaggcgtggagtggcgttggtccgtattacgaaccaactgaacaagtacgcgtaactaatttancgtctagcggtcggtgacgaaggtcgaggttccaacctactcctaccgagagtaagtgtattacgaagaacgaacggacgtacgtatcagacaaagtacgaacgacgaccgtaacgaaaccggacggacgacggaccgttagtacgttacgtcgtacgccgtagacctacgtacccgttacgttacgttaacgtttacgtttttacncggttacgtaacccgg

SEQ ID NO: 60134 - DNA, 704 bp, Homo sapiens
  misc_feature: GYAE6OF02GC2HN.26.57.F02.1.454.CMB.1.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggaggtttgggctgagcgtggtttccgtgtaggctatttaaaggtgtcagtgtcgtaggtgcaggctgggtaggtcggtccgggggaggtccgtgccgacggccggggggtcctagaactctcatgtggcaggtcncgttagatctagattcaagtnacgtcgtctaagttatccgtcggggtacccnccagttccgcgggacgggaagggctggnggtcggacccttgggtcttacgttaacgaaccttaaccgagaccgtagtaacggccgtaaattagtttacggcncgtacgtcggttntcggaccgtaaggtcgtaccggtccaacgacggttctaacggcgaacgtgaccggtatacgtaggaaccgtaacgaccgacgttacggtctttaccggtacaaaggtaacgtacaaccgacgttaacccggaaacgtacggaacccggacgggttacgtagttaacgtacccgggtttaacaccggtaaccgtaacgtaacccgttaggttcccggtaacgtttacggtttacgtttacgtttaccggttaccgtttacggtaccg

SEQ ID NO: 60135 - DNA, 797 bp, Homo sapiens
  misc_feature: GYAE6OF02HFD0W.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttattttaaaaggtgtccagtgtcaggtgcagctggtggaggtccgggggaggtcgttggtccgagggcccgggggggtccctaggaaacctcgtcagtggtcgcaggtctcgtggtacttccactacttcgagttcgaccgtcggtctaattactacggttcgggtcccgccgtagtcgtcggaccggggaaagggtcgtagggacggtcggtcgttcgggtaccgttaagttaaccgaaaccctaaaccgttacggaaaccgtaaacggtaccggaccgtaactttaaacgttttatcggtacgtcgggtaccggttacgggttacggaccggtaaagggtaccgttaacgggttcccaacccgtaacgtttaccctacggaacggtaacgtaagtacgttaacgttaccgaacgggtaaacgaaacccggtacggttaaccgttacgttcgtaacgtaacgtaaagtcgaaacgtacgtaccgtaaacggaaaccgacgggaaacgtaccggtacgttagttacgttacgtcggtaacgtaccgtacgtaccgttaacgttacccggttacgtttaacgtttaccggttttaacgtttttccggtaacggttccggttaacccgg

SEQ ID NO: 60136 - DNA, 665 bp, Homo sapiens
  misc_feature: GYAE6OF02JX4OT.26.57.F02.1.454.CMB.1.raw
  modified_base (197)..(197): a, c, t, g, unknown or other
  misc_feature (197)..(197): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggttttcctgttgctatttaaaaggtgtccagtgtcaggtgcgngctggtggacggtcgggggagcttggtccaggccgggggtccctggaactcgcgatcgtagcaggtctacgtcggtattccgactaacgtttcgaaggtcgtaacgttcggacttactaagtcgtacggtcccgtcgacgtcgtacggtaccgggaagggtcgtaggtacggtggtcgttggaccgtagttaacgaacctaacgacgtaacgaaggttaccgcggtaataacgtttacgcgtctggtcgtacggtgacgtacggtctaggttccaacgtactcgacgtaagtactagtcggtacttaccgagtaacggaaccgtaacgggtctaagtctaacgaacgtaacgtacggactaaccggataaccgggaaaccgttggaccgttacgacgttatcgtaacgtcgtcgtacgaggtacctccgtacgttagtacgttacgttactttcggacgtcgttaccg

SEQ ID NO: 60137 - DNA, 786 bp, Homo sapiens
  misc_feature: GYAE6OF02J3EDC.26.57.F02.1.454.CMB.1.raw
  modified_base (542)..(542): a, c, t, g, unknown or other
  misc_feature (542)..(542): n is a, c, g, or t
  modified_base (624)..(624): a, c, t, g, unknown or other
  misc_feature (624)..(624): n is a, c, g, or t
  modified_base (634)..(634): a, c, t, g, unknown or other
  misc_feature (634)..(634): n is a, c, g, or t
  modified_base (712)..(712): a, c, t, g, unknown or other
  misc_feature (712)..(712): n is a, c, g, or t
tcagagactatactcacgaccggtgctcgatttagctcgatatagttgggtttggggctgggagaggagctccagccttgggattcccagctgtctccactcggtgatcggcactgaactacaagagacctcaccagtggtagttgggctgagtcgttcgggttttccttgttagtacttaagtttaaacggtgtaccgtagtcgtcgaggtcgcgtacggtccgtagggtcgggtacgggtccgggggtacgtccggtttcgggccggtaccggggtccccgggggggttaccctacggtaaaccttccgtaccgtaggttcggtccggacggtacggtcttacggaggttactaccgtaacgtcgttaccggtacggtaccgtaccggttacggtacttacgtacggttacgtaccggggtcctacgtcgttaccggcgggtaccggtaaggtcgaggtacggtcgtcgtacgtacgttaacgtaaccgaacctaacggtacaaccgtaacggtaccgtacgtacgttacgttactcggngtcgtacggtacggagaaccggtagtacgtaacgtccgaaccgttatcccgtaagaggtactatacggtacacgaagtacgnggttaaccgnttaacgctaaagtacaacgaacgtacgtaccgaacgttaacggacgacgtaaacgcggttaactcgtactcgtaccgngtaccgtacaaccgttacgttacgttaacgtttccgttagtttacggtttaccggtacggtcccgttaaacggg

SEQ ID NO: 60138 - DNA, 707 bp, Homo sapiens
  misc_feature: GYAE6OF02G46AD.26.57.F02.1.454.CMB.1.raw
  modified_base (306)..(306): a, c, t, g, unknown or other
  misc_feature (306)..(306): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgtgctatttaaaggtgtccagtgtcaggtgcagctggtggagtccgggggagcgttggtccaggccggggggtccctagaaactctcatgtgcaggctctggattcactattcagtgactcggactatactacgtcgggtcccnccgtagtcgtcggaccggggaagggcgtgggaggtcggtcgttgggaccgttaagttaacgaaacccgtaaaccgttaggaacctaaacggtaccgtacgaacttaaacgtttatacggtcttcggtacggttccgggtacggtaccgaaagggtccgtacgggtttaccaacccgtacttccgtacctaggaacgtagtacgtacttacgaaggtaacgtaaacgtaccgggtacgttactaccgtaggtaactaaagtacgtaaacgacgtaaccgtaacggaaaccgtacggaccggtacggtaccgtagttacgttacgtcggtacaccgtaacgaccgttaacgttccgtacggttaacttaccggtttagtttttaccgacggttcgtaacccgg

SEQ ID NO: 60139 - DNA, 638 bp, Homo sapiens
  misc_feature: GYAE6OF02GBALT.26.57.F02.1.454.CMB.1.raw
  modified_base (439)..(439): a, c, t, g, unknown or other
  misc_feature (439)..(439): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggtttttccttgttgcttaattttaaaaggtgtccagtgtcgaggtgcagctgggtgggaggtccgggggaggccttgggtccgagggcccgggggggtccctaggaaacctcgtcagtggtcgcgaggcctcgtggattcactattcagtgactcggtactatacgtacgtcgggtcccgcctagtcgtcggaccggggaaacgggtcgtagggagttcgggcgttcgggtccgttaagttaacgaaccaaaccgtgaacaaggtacgacgaacctaatttacngtcgtgcggtcgagcgaaggctagtccacntctcaganatgacttacgagaacgacgacggtactacgtctacgaactaagtaacgaaactacgaccgtaaacggaaacgcggaacgacgtacgtattattacgtgcgaacgacgaactacgttaccgttacgtaacgtttaccgttattttacgtcggttcgtaaccg

SEQ ID NO: 60140 - DNA, 710 bp, Homo sapiens
  misc_feature: GYAE6OF02GOD5Q.26.57.F02.1.454.CMB.1.raw
  modified_base (130)..(130): a, c, t, g, unknown or other
  misc_feature (130)..(130): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
tcagagactatactcacgaccggtgctcgatttagctcgatatagttgggtttggggcgtgggagaggagctccagccttgggattcccagctgtctccactcggtgatcggcactgaatacagagactnaccatgagtttggctgagctgggtttcctgttgctattttaaaaggtgtcagtgtcaggtgcagctggtggaggtccggggagcgttggtccgaggccggggggtacctggaaactcgtcactgtnccgagcgtcnggtatccatacttcgatgactcggtactactatacgtcggggtccaccgtagtccgtaggacccggggtaaaggcctaggggtacgtcggccgtttgggaccgttaacgttaacggaaacctaaaccgttgaaaccgtaacgtacgaacgtacgtaatttaacggctacgtggtaccgttcggtagtaccgaagttaccggtacggttaccgtaacctacgttcccgtacccgtaaggtaagtacgttaacgacggttaacaagggtaaacgtaacccgtaggtaccgtacttacgtacgaacgtaaacttacgaacgaacccgtcggtaaacgaaacccggtaaggtaccgaacggttaccgtagggttactacggtagtaccgccaaagtccctaagtccgtttacgtacgttacgttacttttcggtaccgtcgttaccgg

SEQ ID NO: 60141 - DNA, 613 bp, Homo sapiens
  misc_feature: GYAE6OF02JWWSH.26.57.F02.1.454.CMB.1.raw
  modified_base (317)..(317): a, c, t, g, unknown or other
  misc_feature (317)..(317): n is a, c, g, or t
  modified_base (461)..(461): a, c, t, g, unknown or other
  misc_feature (461)..(461): n is a, c, g, or t
tcagagactatactcacgaccggtgctcgatttagctcgatatagttgggtttggggctgggagaggagctccagccttgggattcccagctgtctccactcggtgagtcggcactgaatacaagagactcaccatggagtttgggctggagctgggttttccttgttgcttattttaaaggtgtccagtgtcaggtgcagctggtggaggtccgggggaggtcgttggtccgaggccggggggtcctgaaacgtctcgatgtgcgaggctcgtggattcactagttcagtgactcggctaatatacgtcggtaccncgagtcgtggaccgggaaaggcgtggagtggtacgttggacgttaagttaacgaaccaaaccgtgaacgaagtacgacgtaactaagtttacacgtcgtagtcgtaggtacgacgaaggcgtacgtacactacgtcgaccaganactgatacgagaacgaacggcgtacgtactcgtagtactaaagtacgaaacacgacgtacgaaaacgcgaacgcggtacgtacgttacgtacttggcgtaccagacttacgtccgttacgttacgttacgttatttacgtcggtagtacccg

SEQ ID NO: 60142 - DNA, 680 bp, Homo sapiens
  misc_feature: GYAE6OF02G2JNB.26.57.F02.1.454.CMB.1.raw
  modified_base (504)..(504): a, c, t, g, unknown or other
  misc_feature (504)..(504): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggaggtccgggggaggcgttggtccgagggccgggggggtccctgaactctcatgtgcaggctcgtggattcacattcaagtgactcggctatactacgtcgggtcccgcctaggtctacgggaccggggaaagggcgtgggagtgggcgttggccgttaacgttagaaaccaaaccgtgaacaaaggtaccgacgtaactaaatttagcgacgttcggtcgttcgggcggaccgaaggggtcctaacggttccaacctacgtaccgactaggtagtagtacggtagttacaacggtanaaaccgacggtatacgtcgagaaccgtaagtaacgaacgtaacgaccgtaacggaaacccggacggaaccgaaccgggtacgttacgttacgttacgtacggtcgaccgaacgtacctaccgttaccgttacgttaacggtttactttaccgtttttcgaccggttcgtaacccgg

SEQ ID NO: 60143 - DNA, 734 bp, Homo sapiens
  misc_feature: GYAE6OF02GLXGS.26.57.F02.1.454.CMB.1.raw
  modified_base (221)..(221): a, c, t, g, unknown or other
  misc_feature (221)..(221): n is a, c, g, or t
  modified_base (525)..(525): a, c, t, g, unknown or other
  misc_feature (525)..(525): n is a, c, g, or t
  modified_base (570)..(570): a, c, t, g, unknown or other
  misc_feature (570)..(570): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccagtggagtttggctgagcttgggttttcctgttgcttagtttaaaggtgtaccgagtgtcaggtgcagcgtggtggacggtccggggngtcgttcggccgagggtcccggggggtcctaggaaacctccgtagtacgttcggtgcgtacggtccgtcgtacggtatactactagttacgaagtcgtaccgtacggtaccttagttacgtaccgttcgggtacccgtacgtaggttccgtaacggggaccgggtaaaggtcgtagggtacggtaggtcggttcggtaccgttaaggttaacccgaaaccgtaccgtaggaaactaacggtccggtaccgtaaataacggttacgtgtccgtagtcggtacgtagtacgaggtcctaggtaccnctacgtcgctagagtctagcttacgagaacgacgtacgacgttanagtacgaataagtcgtaaccgcgtaacgtaaaccgaacggtacgacggttaccgtacgttcgttaacgacgttccggaccggtaactccggtaacgtaccggtttccgtaaacggttttcttaaaccgttttacggttaccggtaacccgtttgggtaaacccg

SEQ ID NO: 60144 - DNA, 883 bp, Homo sapiens
  misc_feature: GYAE6OF02I481H.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagcttgggttttccttgttgcttattttaaaaggtgtccagtgtcaggtgcagctggtggaggtccggggagcttggtccaggccggggggtcctaggaaactcgtcacgtgtcgcgaggtctcgtggatttccacgtattccaggttacgaccgtcgggtaccttaattacgtaaccgttcggggttaccccgccgtaacggttccgttacggacccggggggaaaaggggtccgttaggggtaacggttcggggtccgttttacggggaccccggtttaaggttttaaaccggaaaaccccgtaaaaacccggttcggtaaacccgtaaaacgggttacccggaccgttaaaccgttaaaagtttttaaacgtcggtacgttacgggtaccggtttaccggggtacgtaccgtaaacgggcgtaacggggttccctaaacccgtacgttacccgtaccgaaggtacgtaagtacggtacgtttacgaaacggtaacgaaaccgacgggtaccgttaaacttccggtaacgtaacgtaaaacgttacgaaaaccggtaccgaaccgtttaaccgggaaaaacccgggttacggaaacccggtaaaccgggtccgttacgttacgtttaaccgtacggttaccggaccgtaaaccgtaccgtaacccgtttacccgttaacggtttaccgtttaacggtttacttttttaccggacggtttcccggttaaacccgg

SEQ ID NO: 60145 - DNA, 872 bp, Homo sapiens
  misc_feature: GYAE6OF02GDQHF.26.57.F02.1.454.CMB.1.raw
  modified_base (846)..(846): a, c, t, g, unknown or other
  misc_feature (846)..(846): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttggctgagcttgggttttccttgttgtcttattttaaaaggtgtcctagtgttcaggtgcgagtcgtgggtgggaggttcccggggggaggtccgtttcgggtcccggacggggtccccgggggggttaccccttacggtaaaaccgttcctacgtacgtgtacgcgacggtccttcgttaggtacttaccacttaagttacgaggttccgtaccgttaccggtacttaacgttagtaccggttccgggtccccgccgtaggttaccggtccgggtaacccgggggtaaagggtccggtagggtacggtggggtccggtttacggtaccggtttaacgttaaaccgaaacccctaaaccggtacgtaaaccgtaacggttaacccgtacgtaaacgtttaacgtttagtcggtcgtacggggttccgttaacgggtacggtaccgtaacggggtaccgttaacggttacccctaaccgttacctaccggttaccaacggtagttactacggtaatacgaacggttaacggaaccggtcggtaacgttacgtcgtaacggaactaacgtaaccgaacgtaccggtaaaccgtaaccgggaaaaccgtaccgggaaccgttacgggtaccgtttattaccgttccggttaagccgtaccgtaagtaccccgttacgtaccgtttacggttacgttttaaccggttttntttaccggtacgttacccggtaaccg

SEQ ID NO: 60146 - DNA, 745 bp, Homo sapiens
  misc_feature: GYAE6OF02FNWMK.26.57.F02.1.454.CMB.1.raw
  modified_base (324)..(324): a, c, t, g, unknown or other
  misc_feature (324)..(324): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctggttttccttgttgctattttaaaaggtgtccagtgtcaggtgcagctggtggaggtccgggggagcgttggtccgagggcccgggggggtccctacgtaaactctcagtgtgcgaggctcgtggattcgacattcgagtcgacgtcggacttatatacgtcggtccgccgngtcgtggaccgggaagggtcgtagggtacgtcggtcgttacggtccgtattaacgaacctaaacctgaacgtaagtaccgacgtaacttaattacgtagtcgtcggtacggttcggtcggtaacgtaacggtcgtaacggtttacccaaacccggtattccccgtaacgtaggtaacggtacgttaggtaactccggtaaacgaacggtaacccgtaccggggtattaaaccgtccgttaacgaacctaaaaggttacggaaacgtaaccgtaccggtaaacggaaaccgaaccggacgaacccgggttacgttaacggttagttacccgtgggtaccaccgtaaacggtcttaaccggttccgtttaacggttactttttaaaccggtttacttttacggttaacgggttcgtaacccgg

SEQ ID NO: 60147 - DNA, 774 bp, Homo sapiens
  misc_feature: GYAE6OF02INK68.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaagttttaaaaggtgtccagtgtcgaggtgcagcgtggtgggaggtccgggggaggtcgttgggtccgacggggtcccggggggggtaccctacggtaaaacgtcgtacgagtggtcgacggacgggtcttacggtggtacttacgaacctagtttacgaggttacgacgtcggtacttagtaacgttacggttcggtcccgaccgtagtacgtacgggaaccgggtaaggacgtagggacgggtcgacggttcgggtaccgttaacgttaaacggaaaccctaaaccgtacgaacgtaaacgtaccggacgtaaacttaaattacgtgtaccgtaggtccggttcgggtacgacgtaacgggacgtaacggttacctaaccgtactaccgtaccggaagtaacggtacgtagtacgttacgaaggaaacggtaaccgaccgggtaactaacgttaccgaaggtaaaccaaaggttaacgaaacgtaccgtaacgaaccgtaaaacgaacgtacgaaccggtacctagtactacgtgtacgtaccgagaaccgtagtaccgtacgttaactttaccgtttaactttcgtaacggtcgttaccg

SEQ ID NO: 60148 - DNA, 698 bp, Homo sapiens
  misc_feature: GYAE6OF02GKUJ9.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctgggtggagtccgggggaggcttgggtccaggcccggggggtccctggaaactcgtcagtgtgcgaggctcgtggacttcactattcagtgactcggctatactacgtcgggtacccgcgagtcgtcggccggggaaagggtccgtgggagtgggtcgttgggaccttagtaacgaacccaaacgtgaacgtaacgtaccgacgaactaatttagtcgcgtggtccgttcgggtgaccgaaggtccgtacggttacccactacgtccgtacgacggagtactaggtacttacgagtaaacgaaccggtaccggtcgttaactctacgaacgtaagtaacgtaacgtaaccgaccgtaaacggaaaaccggtaacgaaccggaccggtaccgtacgtttaacgttacggtacggtacggaccgtacgtaacgttaccgttaccgttacggttaacgttttaccgttttactttttacggtacggttaccgttacccggg

SEQ ID NO: 60149 - DNA, 638 bp, Homo sapiens
  misc_feature: GYAE6OF02HUZB0.26.57.F02.1.454.CMB.1.raw
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
  modified_base (496)..(496): a, c, t, g, unknown or other
  misc_feature (496)..(496): n is a, c, g, or t
tcagagactatactcacgaccggtgctcgatttagctcgatatagttgggtttggggctgggagaggagctccagccttgggattcccagctgtctccactcggtgatcggcactgaatacaagagactcacatggagtttgggctgagcgtggtttctgtgctatttaaaaggtgtcagtgtcaggtgcagctgggtggagtccgggggaggcttggtccgaggccgggggggtcctaggaaactctcatgtgcaggctctggattnactattcagtgactggctanatcgtgggtccgcagtctggacccgggaaggctagggngtgcgttggcctagttaacgaacctaaacgtgacaagtacgcgtactaaattttancgcttggccgtttcgggagtacggaacggcgtgggtttacacgtaactccgtaccgaggtataagtggtaactttacgaaaggtaacgtaacggaaccggtcgttaacttacgngtaacctaaagtagaaaccgacgaccgtaacggaaaaccgcggtaaacgaccggtaccgttagtacgtttaccgtgtcgtaccgagtacacgttaccgtacgttaacgttaccggttaactttttcacggtttcggtaaccg

SEQ ID NO: 60150 - DNA, 652 bp, Homo sapiens
  misc_feature: GYAE6OF02FKC74.26.57.F02.1.454.CMB.1.raw
  modified_base (297)..(297): a, c, t, g, unknown or other
  misc_feature (297)..(297): n is a, c, g, or t
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (511)..(511): a, c, t, g, unknown or other
  misc_feature (511)..(511): n is a, c, g, or t
  modified_base (527)..(527): a, c, t, g, unknown or other
  misc_feature (527)..(527): n is a, c, g, or t
  modified_base (627)..(627): a, c, t, g, unknown or other
  misc_feature (627)..(627): n is a, c, g, or t
tcagagactatactcacgaccggtgctcgatttagctcgatatagttgggttgggctggagaggagctccagccttgggattcccagctgtctccactcggtgatcggcactgaatacaagagactcaccatggagttgggctgagcttgggtttcttgtgcttagttttaaaggtgtccagtgtcgaggtgcagtcgtggtggaaggtcccgggggagcgttgggtcccaggggcccgggggggtccctagaaaccgtctacaagtcgtagacagggccttgtacggattccactnttaccgagttgacctcggacttatacgtaccgtcggtaccgcctacgtcgacgggcgggaaacggcgtagggaggcggtcgttcggaccttaagtacgaaaaccgactcgaacgtacgacgaacgactaatttacgngtacgtcggtcgtcggganacgacggcgtaggtaccacgtntccgtacagaagctanacgtnagacgaacgacggtntagtctacgaacgaanacgacgacaacgtacgaaacgacggaaactcggtcgtattaccgagcgtaacggacctacgtaaccctggttaacccgtagtttacgtttaaacggtttntttaccggttacggacggttaccgg

SEQ ID NO: 60151 - DNA, 732 bp, Homo sapiens
  misc_feature: GYAE6OF02FZ6MD.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccgaggcccgggggggtccctgaaactctacgatgtgcgaggctcgtggacttcactatttccgagtagacgtcggactagtactacgtcgggtcccgccgtaggtccgtacggacccggggaaagggtccgtgggacggttggccgtttgggaccgttaagttaacgaaaaccctaaaacccgtaggaaccaaacgtaccggaccgtaacctaaattttactgtcttgtccggtcggtcgcgaaacgggtctaggttccaacccgtactcccgtacccgaaggacgtaagtacgttaacgttaccgtaaggtaaacggaacccgtaaccggtaccgttaacttaccgtacgtaacctaaaggtaacgtaaccgaacgtacccgttaacggaaaaccgaacgggtaccgaaccgggtccgtagtactttacggtagtccgaccgtacgaaccgttacgtaccggtacgttacgtttaaccgtttatttttaccgtacgtcgttacccg

SEQ ID NO: 60152 - DNA, 906 bp, Homo sapiens
  misc_feature: GYAE6OF02JAINX.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagacgactcaccatggtagtttgggctgagcgtgggttttccttgttgcttattttaaaaggtgtccagtgtcaggtgtcagctgggtggaggtccgggggaggtcgttcgggtccgtaggtccccgggggggtcccttaggtaaacccgttcctaccggacgttcggttcggacccgtagggtcctcgtggtacgtttaccaacctagttcaacggttcgaaccgttccgggtaccttaagtacgttaccggtcggggttaccccggtacccgtaacggttccgttaccgggacccgggggtaaacgggcccggttagggtaggttccggggtaccggtttcgggtaccccggttaagtttaaaccgggaaacccgtaaaccttaggaaaccctaaaggttaaccgggcgtaaaactaacgttttacgtacgtcgttacgcggttacgggtcgtacgtaaacgggtcgtaaccggttaccgtacccgttaacgtaccgtaccgaacggtacgttaacgtcgttaacgtaccgtaacgttaaccggaaaccgtaacgggtaccgttaacgtaccgttacggaactaaacgtaccgtaaaccgtaccggttaaccggaaaccggttaaaacccgggaaccggaaaccggtaacccggtaccggtttaaccggtaaccgtttacgtacggttaacccggtaaccgtaaccgtaacccggttaccttaccggttaacggttaccgtttaacctttacggtttttaaccggcgttaccggttacccgg

SEQ ID NO: 60153 - DNA, 713 bp, Homo sapiens
  misc_feature: GYAE6OF02FF2S3.26.57.F02.1.454.CMB.1.raw
  modified_base (180)..(180): a, c, t, g, unknown or other
  misc_feature (180)..(180): n is a, c, g, or t
  modified_base (304)..(304): a, c, t, g, unknown or other
  misc_feature (304)..(304): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttgggctgagctgggttttccttgttgctattttaaaaggngtccagtgtcaggtgcagctggtggagtccgggggaggcttggtccaggccgggggggtccctggaaactctcatgtgcgaggtctctacggattcactattcagttgactggcttatactacngggtccgccagtcgtaggccgggaaagggcctggacggtggcgttgggaccgttagttaacgaaccctaaaccgtcgaacgtaagtaccgcgtaactaagtttatacgtctacgccggttcggtacgacgtaacgggcgtaacggtttcccaaccctagtacccgtacccgtaggtacgtaattacgtacgtacgtaacggaacggtaaccgtaccggggtaccgttaacgtcgtacggtaactaaacgttacggaaaccgacggtaaccgttaaccggaaaacccgggaacggtaaccggacccgggtaccgttacggtttacgttaccgtggtaccgaccgtaacgtacctaccgtaccgttacgttacgtttaaccgttacgtttttacgacggttacgtaacccg

SEQ ID NO: 60154 - DNA, 733 bp, Homo sapiens
  misc_feature: GYAE6OF02I3ID6.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtgggaggtccggggggaggcgttgggtccgagggcccgggggggtccctgaaactctcatgtgcgaggctctggtattcactattcagtgacctcggcttatatacgtcgggtcccgccagtcgtcggaccggggaaagggcgtgggaggtcgggtcgttacgggtccgttaacttaacggaaaaccctaaaccgttacggaaacgtaaacggtaaccggtaccgaaacttaaagttttacgtacggtcgttacgtccggttcgggtagacggtaagggccgtaacgggttaccgaacctaacgttcctaccgaggacgtatacgtacttacgaacggtaacgaaaccgtacggtacgttaacgtaccgtacgtaactaaacgtacgaaacgtaaccggtaccgtaacggaaaaccgaacgggaaccgtaaccgggtacgttacgttagttacgttacggtacgtaccgacgaacgtacgttaccgttacgttactttacgttacgtttttacgtacggttcgttaccgg

SEQ ID NO: 60155 - DNA, 655 bp, Homo sapiens
  misc_feature: GYAE6OF02GBNEE.26.57.F02.1.454.CMB.1.raw
  modified_base (411)..(411): a, c, t, g, unknown or other
  misc_feature (411)..(411): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttggctgagctggtttcctgttgctatttaaaaggtgtccagtgtcaggtgcagctggtggagtccgggggagcgttggtccgaggccggggggtccctgaaactctctatgtgcgtagctctggattcacattcgagtgacgtcggactatacgtacgtggtacccgccagttcgtggaccgggtaaagggcgtagggaggtgtcgttcggaccgttaagttaacgaacctaaaccgtgaacgtaagtaccgagtaactaactttagtcgntacggcggtacggtcgacgaaggcgtacgttacacctactctaccgtaagtacgtatacgtactacgtaacggaaccgtaacgtaccggtacgtagtctacgtaacgtaaactacggtaaccaggtaccgtaaggaaaccgtaacgacgacggtacccgtagtacgttacgtcggtacaccgagtaaccgtcgttaccgttacggttactttaccgttacgttttccgtacggttcgtaaccgg

SEQ ID NO: 60156 - DNA, 804 bp, Homo sapiens
  misc_feature: GYAE6OF02ILMW3.26.57.F02.1.454.CMB.1.raw
  modified_base (322)..(322): a, c, t, g, unknown or other
  misc_feature (322)..(322): n is a, c, g, or t
tcagagactatactcacgaccggtgctcgatttagctcgatatagttgggtttggggctgggagaggagctccagccttgggattcccagctgtctccactcggtgatcggcacctgaatacaagagactcaccatggagtttgggctgagcttgggttttccttgttgcttaattttaaaaggtgtccagtgtcaggtgcagctgggtggaggtccgggggaggtcgttcgggtccgacgggcccggggggggtccctacggaaacctctacgatcgtcgcgaggtcctcgtggtacttcgactattcgagtgactcggtntactactacgtcgggtccgcctaggtcgtcgggaccggggtaaagggcgtgggagttgggtcgttcggtaccttagttaaccgaaaccgtaactacgtaacgaacgtacgaccgtaataagtttacgtgacgtcgtcggtacggtccgaacggtaacgggtcctaacgggttccctaaacccgtacgttccccgttaacggacgtaacggtaacttacgtacgttacgaaaggtaacggtaacccgaagggttaccgttacgttctaacgacgtaaacgtaccgtaaacgacgtaacccggtaaacgaaaaaccccggtaagggtaaacccgtacccgggtaccgttagtttaaccggtttccgttacgggtaaccgaccccgttaaacggtaacccttaccggttaacccggtttacccgggtttaactttttaaaccgggtttacttttttacggttaccgggtttcccgttaacccggg

SEQ ID NO: 60157 - DNA, 854 bp, Homo sapiens
  misc_feature: GYAE6OF02IHHG6.26.57.F02.1.454.CMB.1.raw
tcagagactatactcacgaccggtgctcgatttagctcgatatagttgggtttggggctgggagaggagctcagccttgggattcccagctgtctccactcggtgatcggcactgaactacaagagactcaccatggtaggtttgggctgagtcgttgggtttttccttgttgtactttaatttttaaaaggtcgtaccaaggttgtacgtagggttgccgagtcgtgggtagggtacgggttccgggggagtcgtttggaccgcggggcccggggggttccctgtaacctcgtacgagtgtcgcgacggtcctgtgtacttacactacttacgaggtcgtaccgtcggtacttaagttaacgtccggttacgggtccccgtacgtacggttccgttaaccgggggacggggtaacggtaccgttgggacgttcggtcggtcggtaccgtttaaacggtaactaaacccgtaaaccgtacggtaaccgtaagggtacccgtaacgtaaactttaacggtttatccggtcgttaacgggtccgggttaacgggtcggaaccggtaacgggtaccggttaaaccgggtttccaaacccgtttacgttacccggtaaaccggaggttaccggaaagtttacggtactttaacgaacggttaaaccggtaaccgacgggttaccgtagtttacgaacgtaacgtaaataccggtaaaccgtcgtaaaccgtaaaccggaaacgggtcgtaaaccgtccggttaacgttagttacccgttagggttccaacgtaccgacgtaacgttccgttacggttcgtttacgttaagtttccgtttaaccgtgtttcccgtacgg

SEQ ID NO: 60158 - DNA, 834 bp, Homo sapiens
  misc_feature: GYAE6OF02JL2WZ.26.57.F02.1.454.CMB.1.raw
  modified_base (190)..(190): a, c, t, g, unknown or other
  misc_feature (190)..(190): n is a, c, g, or t
tcagagactatactcacgaccggtgctcgatttagctcgatatagttgggtttgggctgggagaggagctccagccgttgggattcccagctgtctccactcggtgatcggcactgaatacaagagactcaccatggaggtttgggctgagcgttagggttttccttgtacgtcttaagttttaaaggtntccgagtgtcgtaggtgctagctggtggtggtaccgggggagtcgttcggtaccgcgggtcccggggggtccctacggtaaaccttcgtacgagtcgtggccggtaggtccttcggtggtaacttccgattacttccggaagtcgaacgttccggtagttacgttaacgttaccggtccgggtacccgtcgtaggttcgtaccgggtaacgggtccggggtacgtacgggtaggttcggttggtaccggtaccggtttaaacgtaacccggtaaaccttaaccgtacgaaccgtaaacggtaccggaactaaaggtttaaaccttggaacggtttccgtaggtcggttaccgggtacgaacgggtaaccggtacgttaccggtacccgtaacgtttaccgtacgtacccgtaaggtaacgtacggttacggtacgtacgtaaggtaacgtaaacggccggttacgtacgtacggtacttaaccggtaaacgtaccggtaaacgtaacggtaacccggttaaacggtaaacccgtaaaggacccggtacggtacgtacgttacgtacgtacggtaacgtcccaggtacgtaccgttacgacgttttttttacgacgttttcgtttacgttccggttacgttcccg

SEQ ID NO: 60159 - DNA, 920 bp, Homo sapiens
  misc_feature: GYAE6OF02HKSG2.26.57.F02.1.454.CMB.1.raw
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
tcagagactatactcacgaccggtgctcgatttagctcgatatagttgggttggggctgggagaggagctccagccttgggattcccgagcgtgtctccactcggtgatcggcactgaatacaagagtactcaccagtggagtttggctgagtcgttcgggttttcctgtgtacgttaagttttaaaaggtgtcctagtgtcgaggtncgtagcgtgggtgggaggtccgggggagtcgttcggtaccgagggtcccggggggtacctagtaaactcgtcgagtcgtgcgnggtcgttcgtggtactttcatagttacgaggtcgtacgtacggtactaagttagtaccggtcgggtcccgtacgtaggttcggtacgggaaccgggtaacgggtcgtagggtacggttcggtcgtttacgggtaccggttaaacgtaaaccggtaaaccccgtaaacgtacggtaaacgtaaacggtaccggtaccgttaaacggtttaaagttacgtacccggtacgttccgggtaccggtttacgggacgtaaaccggtaacgggtaccgttaaccggttacccgtaaaccgtaccgttaacccggtaacccggtaaggtaaccgttaagggtaccgttaaggttaacgggaaacggaaaccggtaaacggtaccgggttaacggtaacttacggtaccgttaaaccggtaaacgttaacgaaacccgtaccggtaaaccggttaaacccgggaaaacgttaccggggaaaccgttaaccgggttacccgggtttaacgttaaaccggtttcgtaccggttaacccggtaaccgtaacggtacccggttacgttaacccggttaacggtttaacccgtttcccggttttaaagggttttcccgtaccgggtttacccgtaacccggg

SEQ ID NO: 60160 - DNA, 916 bp, Homo sapiens
  misc_feature: GYAE6OF02JFF3S.26.57.F02.1.454.CMB.1.raw
tcagagactatactcacgaccggtgctcgatttagctcgatatagttgggtttggggctgggagaggagctccagccttgggacttcccagctgtctccactcggtgatcggcactgaatacaagagactcaccaatggtagtttgggctggagtcgttcgggttttccttgttcggactttaagtttttaaaaagggtgttcccgtaagttgttcgagggtcgacgacggtctggggtacgggacgggtccgggggggacggtcgtttcgggccggacgggggtccccgggggggttccctaggtaaaccgttcgtaccgagttcggtcggactacggtccttcggttaggtattacctactgttacgaggttaccgaccgttacgggtaccttaagttacgtaaccggttccggggtcccggtaccctaggtttccggaccggggaccgggggtaaaagggtccgtagggggtacggtcgggttaccggtttaggggtacccgtttaacggttaaaccgaaaccccggtaaaccgacggtaaacgaaaccggttccgaaccggttaacttaaagttttacgacggttccgtaaggtccggttcggttacggacgtaaggcgtaacggttaccaccgtacttacccgaccgagtaactacggtagtaacttaccgaagggtaccgtaaacggtacccgttacgtagtaccgtacggtaaacctaaagtaccgaaacggtaccaaccgggttaaccgaaaaccgggcgtaaaccggttacccgggttacggtttaacgtacgtttaaccgagggttcccgaaaccgtaccggttaaccgtaaccgttttacccgtaacggttttaattttaaaccccggtttgttttaacccggtaacggttcccgttaacccggg

SEQ ID NO: 60161 - DNA, 785 bp, Homo sapiens
  misc_feature: GYAE6OF02IMX3T.26.57.F02.1.454.CMB.1.raw
  modified_base (208)..(208): a, c, t, g, unknown or other
  misc_feature (208)..(208): n is a, c, g, or t
tcagagactatactcacgaccggtgctcgatttagctcgatatagttgggtttggggctgggagaggagctccagccttgggattcccagctgtctccactcggtgatcggcactgaatacaagagctcaccatggagtttgggctgagcttgggttttccttgttgcttaagttttaaaacggtgtccagtgtcaggtgcagctggnggaggtcggggagtcttggtcgaggccgggggtccagaaactctacagtgtagcaggtctcgtggtattacactagttcgagttagaccgtcggtcttaagtaacgttaccgttacgggtacccgaccgtaaggtaccgttacgggaaccggggtaaagggtccggtagggtacgttcggacgtttacgggtaccgttaacgttaaacggaaaccctaaccgtacgtaacgtaaacgggttaccgacgtaactttaaacgtttagtcggtaccgttacggtacgttacgggtacgaaccggtaacggtaccgttaacggttacccaaaccgtacgtaccgtaacccgaagtaacgtagtacggtaacttaggtaacgaacgtaaaccgtaccggtagtaccgtacgtagaacgtaaacgtagaaccgtagaaccgtaacggaaaaccgaggtaaccggtaaccggtaccgttaacgttacgttaacgtcggtaacgacccgtaagtaacccgttacggtaccggttacgtttaaccgtttaccgtttacgttttacggtacggttcccgttaacccg

SEQ ID NO: 60162 - DNA, 757 bp, Homo sapiens
  misc_feature: GYAE6OF02GF7QA.26.57.F02.1.454.CMB.1.raw
  modified_base (176)..(176): a, c, t, g, unknown or other
  misc_feature (176)..(176): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggtttctgttgctatttaaaggntcagtgtcaggtgcagctggtggaggtccgggggaggcgttaggtccgacggtccggggggggtccctaggtaaactctactagtcgtgacagggcttcgtggtatcctactattacgaggttcgacgttcggattataacgtacgtcggggttccgcctaggtcgtagggacccggggaaagggtcggtagggagtgggtcgttcgggaccgttaacgttaacgaaaccaaccgtagaaaccgtaaggtacgacgtaactaattttagacgtcgtacgtcgggtaggtacggacgtaacgggactagggtaccgtaccctacgttcctacggaacgtaggtacttagtacttacgaacggtaacgtaaccggtacggtacgtacttacccgagtaaccgaaagttacgaaacggccgtaaaccgaaacgggtaaaaccggaacggtaaccggtaacccggtacgggttaatttacccggtaagtcgggtaccaaccgttaaccgtaaccggtaaccgttccggttaaccgtttaacgttttaccgtttaaccgttttcggtacgttacgggttaacccgg

SEQ ID NO: 60163 - DNA, 853 bp, Homo sapiens
  misc_feature: GYAE6OF02ITI14.26.57.F02.1.454.CMB.1.raw
  modified_base (767)..(767): a, c, t, g, unknown or other
  misc_feature (767)..(767): n is a, c, g, or t
tcagagactatactcacgaccggtgctcgatttagctcgatatagttgggtttggggctgggagaggagctccagcccttgggattcccagctgtctccactcggtgatcggcactgaatacaagagactcaccatggagttttgggctgagcgtttgggtttttccttgttgcttaattttaaaaggtgtccagttgtcaggtgccagtcgtgggtagggtacggtccggggggtaggcgtttgggtcccgtacggggcccgggggggggttaccccttaggaaaaccttccgtacgacgtggtcgcgaggccttacgtggtacttcgactattccagtgaccgtcggacttagtaacttcggtcgggtaccccgcctaggttccgtacgggaccgggggtaaacgggcggtgggaggttcggtccgttagggtacccgtttaaagttaaccgggaaaacccctaaaccgtcggtaaaccgtaaacgggtaccgtaacccggtaacgtttaaatttacgtacggttaccttcgggtaccggttccggggttacgaccgggtaaacgggtccgttaacggtcccgtaaacccgtagttcccggtaccgaaggtacgtaacgttaccgtattacggaaggaaccgtaaccggtaccggttacttaagtccgttaacggaaattaaccgtaacggaacgaaccgttaccgtaaacccgggaaacggtaacccggaacgttaccgggtacgttttaggttacctttacgnggtaccgtaccgaaagttacgttccgttttacgttaacgtttaccgttttagtttaccgttttacggttcggtacccgtttaccgg

SEQ ID NO: 60164 - DNA, 600 bp, Homo sapiens
  misc_feature: GYAE6OF02FWWB4.26.57.F02.1.454.CMB.1.raw
tcagagactatactcacgaccggtgctcgatttagctcgatatagttgggtttgggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccgaggcccggggggggtccctgaaacctctcatgtgcaggctctggattcacattcagtgactcggctatatacgtgggtccgcagtctggccggaaggcgtggagtgggcttgggccgttagttacgaaaccgaaacctgaacgaacgtacgacgaactaatttagtgactgcgtcggtgacaaggcgtagtcacactctcagagagtgactcagagaacgtacggcgtatcgtagacgaaagtagaacgacgtaccgtaacggaaaaccgaggaaaccgaccggtacgtacgttacgttacgtgtcgaccgacgaccgtactaccggttacgtttacgttacgttacgtttttactacggttccgttaccg

SEQ ID NO: 60165 - DNA, 810 bp, Homo sapiens
  misc_feature: GYAE6OF02HT799.26.57.F02.1.454.CMB.1.raw
  modified_base (199)..(199): a, c, t, g, unknown or other
  misc_feature (199)..(199): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaatttaaaaggtgtccagtgtcaggtgnagcgtggtggaggtccgggggagtcgttgggtccgacgggcccggggggtcctagaaaccgtctcataggtgccaggtctacgtggtacttcaacgtattaccgtaagtgaaccgtaccggtcttaactagtaaccgttcggggtaccccgaccgtaggttaccgtacgggtaaccggggaaagggtccgtacgggaaggttcgggtccgttacgggtacccgttaaagtttaaccggaaaaaccccgtaaaaccgttcggaaacccgtaaacggttaacccgaccggtaaaccttaaagtttaagtcggtacgtacgcggtttacgggacgaacgaacggtaccgtaaggtcccaaccgtacgtaccctaccggaagacgtactacgtatacgaagttaacggaacgacggtacgttaactcgtacgaacgtaaacgtaccgaaccgtaaccgtaaccgtaaacggaaaacccggtagggaaccctaaccgggtaccgttaaggttaccgtttaccgtaggtaaccgaccgtaacgtaaccgtaccgtttaccgtaccggtttaagtttacccggttttatttttaaccggacggttccggttaaccccg

SEQ ID NO: 60166 - DNA, 921 bp, Homo sapiens
  misc_feature: GYAE6OF02GBS4Y.26.57.F02.1.454.CMB.1.raw
  modified_base (109)..(109): a, c, t, g, unknown or other
  misc_feature (109)..(109): n is a, c, g, or t
  modified_base (277)..(277): a, c, t, g, unknown or other
  misc_feature (277)..(277): n is a, c, g, or t
tcagagactatactcacgaccggtgctcgatttagctcgatatagttgggtttggggctgggagaggagctccagccttgggattcccagctgtctcccactcggtaancgtcgactacgaagtaacaacgaaggactacctaccaactaggtaggtttagggttcggtgtaggacgttcggggtttttccggtttttcgtttggttacgttaacttttttaaaaaagggttttaaggttccgtaacggttaggttcggtacggttaggtacgacgnggttcgggttggggtacgggtaccggggggtcgggggtacgttcgggtttccggaccggggtaccggggggggttcccccgggtaacgtaaaaccggttaacccttccgaacggttggttcggtccggaacgggtcgtccgttaaggtcgttaactaccgtacttacgtacggtagtacgtccggtacgtaacttaacgttaccgttcgggttaccggtcccgacgttccggttcggaaccgggggtaaacggggtacggtcgggtaagggttcggtcgtacgggttccgtaacgttaacgaaacctaaaccgtacgaacgtaacgtaacgacgaactaatttagtcgtcgtgcgtcggtgacgacgacgtcgtacgtacctactctactacgaagtctaggtacttacgaacggtacgtaaaccggtacggtacgttaccgttacgtacgtaacgtaaactaaacggaaccgtaacgaccgttaacgaaaccggtaaaccggtaacggaccgtaccgggttagttaagtttaccgttacggttacggaaccggtaccgtaaccgttaaccgttaaccgttaccgtttaacggtttacgtttttaacgttttaccgtttacggttacggttaccccgttaacgg

SEQ ID NO: 60167 - DNA, 818 bp, Homo sapiens
  misc_feature: GYAE6OF02ICU9I.26.57.F02.1.454.CMB.1.raw
tcagagactatactcacgaccggtgctcgatttagctcgatatagttagggtttggggcgtgggagaggagctccagccttgggattcccagctgtctccactcggtgatcggcactgaatacaagagactcaccagtggagttggctgagcgttggtttctgttgctatttaaagtgtccagtgtcaggtgcagcttgggtgggacggtccgggggagcgttcggtaccgacgggtcccggggggtaccctagaaaccgtcgtacctagttgtcgtcgaggtccgttacgtcggtacttcaacgtactttacgtacgtaccggtacgtccggttacttacgttacgttaccgttcgggttaccccgtcgtacggtacgtacgggaccgggggtaacgggtccggtaggtagggtacgttcggttcggacgttacgttaacgtaaacccgtaaccgtagtaacgaacggtaaccggctaaccgtttaaagtttctacggtacctacggtcggtagtacgaccgtaaggtccggtaggtacctaaccgtacgtacccgtacgtaacggtaagtagttacgtaactaccgtaacgggtaacgtaaaccggaccggttacgtaacgttaccgtacgtaacgtaaacggttccgtaaacggtaccggtaaccgtaaaccgggtaaaccggtaccggtaaccgtaaccgggtacgttaaccgttacgttacggttaccggtacgtaccgtacggtaccttacggtaaccgtttaccgtttacgttaacgtttcggtttttaccgtacggttacgttaccccgg

SEQ ID NO: 60168 - DNA, 709 bp, Homo sapiens
  misc_feature: GYAE6OF02HLVY8.26.57.F02.1.454.CMB.1.raw
  modified_base (424)..(424): a, c, t, g, unknown or other
  misc_feature (424)..(424): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctggtggaggtccgggggagcgttggtccagggccgggggggtccctagaaacctctctagtgtgcgaggctgtggattcactattcagtgactcggactatagtacgtcggggtcccgaccgtacgtcgtcgggaccggggaaagggccgtgggagtcgggtcgttgggcccgttaagttacgaaacctaaccgtagaacaaggtacgacgaactaatttagngactcggtcgtcggtgacgtaacggctacggttaccaaccgtacttaccgtaccgaaggtaagtagtacgtaacgttacgaacggaaacgtaaaccgtacgggtaacgttacgtcgtaacgaacctaaagtacgaaacgaccgtaaccgtaacggaaaccgaacggaaccgaccgggtaccgttagtacgtttacgtcggtacgaccgaagtaacccgtaccgttaccggtacgtttaaccgtttaacgttttacgtttttaccgtacggttaccggttaacccg

SEQ ID NO: 60169 - DNA, 787 bp, Homo sapiens
  misc_feature: GYAE6OF02JSFWE.26.57.F02.1.454.CMB.1.raw
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
tcagagactatactcacgaccggtgctcgatttagctcgatatagttgggtttggggtcgtgggagaggagctccagccttgggattcccagctgtctccactcggtgagtcggcactgaatacaagagactcaccatggagtttgggctgagctgggttttccttgttgcttattttaaaaggtgtccgagttgtcaggtgacagcctggtggaggccgggggaggcgttgggtccacggccgggggggtcctagaaactctcatgtcgngaggtctgtggtatcatagttacngtcgactcggtactaacgttgtaaccgttcggggcccgtacgtacgtccgtacgggaaccggggaaaggggtccgttaaggggtaggtcgggttcgttcggggtaccgttaacgttaaacggaaacccctaaacgtcgtaaacgtaacgggttaaccgacggttaacttaaagtttcgacggtaccgtgggtacgtcggggtacaaccggtaagggcgtaaccggttactaaccgtacttcccgtacgtaagtacgtaagttacggaacttacggaacgtaacgaacggtaacgggtcttacgtcggtaacctactaaaagggtccaaacgtcggaaccctaaagggaaaccgtaacggaccgttaacggaccgttacgttacgtaacctttggtaacccgtaccgaacggtaaccgttaaccggttaccgttaaccggttttacgtttaaccggtttttccttttaacgggtacggttacccgtttaacgg

SEQ ID NO: 60170 - DNA, 728 bp, Homo sapiens
  misc_feature: GYAE6OF02JZ8YD.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagctggtttcctgttgctatttaaaggtgtcagtgtcagtgcagctggtggagtccgggggaggtctggtccgacggccggggggtccctggaactctcagtgtgacgaggctcgtggtacttcgactacttcgacggttgaccgttcggactactagtaccgtgggtcccgacgtacggtcgtaggtacccggggaaaggtcgtgggtagtggtcgttgggtaccgttaagttacgaaccgtaaacgtgaccgtaaacgtccggactactaagtttacgtcgtacgtcgcggttacgggtacgtacggtaaaggtcggtaacgggtttcccaacccgtacgttccgtaaccgaggtaacgtccgttagtacgttacgaagggtaacccgtaaaccggtacgggttacccgttaagtaccgttaaccggaagtttaaaacgccgtaaaacgtacccgtaaccggtaaacccggaaaaccgtgggaaccccaacggggttacctaacgggttacacgttacggagaccctagaccgtacgtccgttacgttaggttacctttcgttactgggtaccttaccg

SEQ ID NO: 60171 - DNA, 748 bp, Homo sapiens
  misc_feature: GYAE6OF02H1RZG.26.57.F02.1.454.CMB.1.raw
  modified_base (130)..(130): a, c, t, g, unknown or other
  misc_feature (130)..(130): n is a, c, g, or t
  modified_base (221)..(221): a, c, t, g, unknown or other
  misc_feature (221)..(221): n is a, c, g, or t
  modified_base (686)..(686): a, c, t, g, unknown or other
  misc_feature (686)..(686): n is a, c, g, or t
tcagagactatactcacgaccggtgctcgatttagctcgatatagttgggtttggggctgggagaggagctccagccttgggattcccagctgtctccactcggtgatcggcactgaatacaagagactnaccatggagtttggctgagcttgggttttccttgttgcttattttaaaaggtgtaccagtgtcaggtgcagcgtggtggaggtccgggggnggcttggtccgacgggccggggggtccctaggaaactcgtacagtggtcgcgaggtcgtcgtggacttcactattcgagtagtccgtcggacttatacgtacgtacgggtcccgcctaggtcgaggacgggaacggtctggggtagtcgggtcgttaggtccgttaagttaacgaaaccgtaaaccgtcgaacgaacgttaaccgggacgttaacgtaaatttacggtacgaccgttcgggtaccggttcgggttacggaccggaacgggttccgtaacgggtttacctaaccctacgttccgtacgacgtacgtagttacgtacttaccgaaggaaccgtaaccgtaacgggacgttacgtacgagtaactaaacggtaacgtaacgaaccgtaacggaacggtaaaccggacggtaaaccggtcggtaccgttagttaccgtcgtacggtcgaaccggttacncgtttaccggaccgtttacgttacgttaaccgttttacgtttacggtacgtccggttaaccg

SEQ ID NO: 60172 - DNA, 876 bp, Homo sapiens
  misc_feature: GYAE6OF02H3I6P.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgcttattttaaaaggtgtccagtgtcaggtgcagctgggtgggaggtccgggggaggtcttggtccgagggtcccgggggggtccctaggaaactctcatgtgcgaggtctcgtggacttcgactacttcgtaagttcgaccgttcggtacttaagttacgttaccggttcggggtacccggtccctacggttccggtgggaacccgggggggtaaaacgggtccggtacggggtagggttccggggttccggtttacgggtacccggttaaacgttttaaacccggaaaaaccctaaaacccgttacggaaaccgtaaaccggtaccggtaaaccgtaacttaaacgttttacgtacgccgtttaggtcccgggttcgggtacggaaccggaacgggtaccgtaacgggttaccctaccgtaccgttacctaccgtaaggtaagtactaacgttacgttaccgaaaggtaacgaacggtaacggaccgttaacgtacgtacgaaacgtaaacgtaacggaaaccgtaaccggtaaccgtaacggaaaaacccggaacggaaacccggtaacccgggtaccggtttacgttaacgttccggttaaggtaccggtaccgtaaacggaaccgttaacccgtcccggtttacgttttaaccggtttaacccgttttacgttttttaaccggtacggttacccggttaacccgg

SEQ ID NO: 60173 - DNA, 788 bp, Homo sapiens
  misc_feature: GYAE6OF02INKR3.26.57.F02.1.454.CMB.1.raw
  modified_base (198)..(198): a, c, t, g, unknown or other
  misc_feature (198)..(198): n is a, c, g, or t
tcagagactatactcacgaccggtgctcgatttagctcgatatagttggggtttggggctgggagaggagctccagccttgggattcccagctgtctccactcggtgatcggcactgaatacaagagactcaccatggtagtttgggctgagcttgggttttcctgttgcttaatttaaaggtgtccagtgtcaggtncagtctggtggaggtccgggggagtcgttcgggtccagggtcccgggggggttccctagtaaacctctctagtcgtgcgacggtcttcgtggtacttacgactacgttccgaggttcgtaccgtcggtaccttaagtacgttaccggtcgggtacccgccctaggtccggttacgggaccgggggtaaggtcggtgggacggtcggtacgttcggtaccggttaataaccgaaaaccgtaacgtagaacgtaacggtaccgcgtaaacgtatttacgtgtacgtcggtcgttagggcgtacggtaacggtccgttacggttaccctaacgtcgtaccgtaccgaaggtacgtacgtacgttaaccgtaacgaacgggtaacgtaaccgtacggttacgtaccgtcgaacgtaaccgtaaataaccggtagaaccgttaaccgaaacgggaacccgttacgggtaccgtaaccggtaccgtttaacgttacgtcggtaacggtcggtaaccccgagttaaaccgtccgttaccggtttacgtttaacgttaaccgttttacgggtttccgttacggttacccgttaccggg

SEQ ID NO: 60174 - DNA, 768 bp, Homo sapiens
  misc_feature: GYAE6OF02ICQJP.26.57.F02.1.454.CMB.1.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttcctgtgctattttaaaggtgtccagtgtcaggtncagctggtggaggtccggggggntgtcgcgcggggtccgggtcagactcactgtgtcgacgcgtcttgtgtactcacttgtacgagtacgtaccggtacgtactactacggtacggtcggtcccgacgttcgtacggtacgggaacgggtaacggtcggtaggtcggtcggttcggtacgggtaaccgttaacgtaacccgaaaccgtacgaacgtaacgtaaccggtaaccgacgttaaacttaagtttacgacggtcggtaacgtcggggtacggacgtaacggacggtacgttacgacctactacgttcaacggagtactacgtagtacgtaagaacggtaaacgtaccggtagttacctcgtaacgaacgtaaacttaaacggaaccctaggtaaacccggaaaccggtaaaccgggtaaaccggggtaacgtaacccggtaccggttaacgttaacgttaccggttaacgtacggttaaccggaaccgtaaccgtaccgttaacccgttacggtttaacgttaccggtttaaccgttttaacggttttccgaacgggttccccgttaagg

SEQ ID NO: 60175 - DNA, 681 bp, Homo sapiens
  misc_feature: GYAE6OF02GJNU6.26.57.F02.1.454.CMB.1.raw
  modified_base (386)..(386): a, c, t, g, unknown or other
  misc_feature (386)..(386): n is a, c, g, or t
  modified_base (520)..(520): a, c, t, g, unknown or other
  misc_feature (520)..(520): n is a, c, g, or t
tcagagactatactcacgaccggtgctcgatttagctcgatatagttggggtttggggctgggagaggagctccagccttgggattcccagctgtctccactcggtgatcggcactgaatacaagagactcaccatggagtttgggctgagcgttgggttttccttgttgtacttaatttttaaaaggtcgtccaggtgtcgaggtgcgagcgtgggtcggaggtccgggggagcgtttcgggtccgagggtcccgggggggtccctacggaaactcgtacgagtcgtcgcgacggctcgtggacttacgacctagttcagttcgactcggacttatacgtacggtcggtaccgcgtacgtccgtcggaccgggaaggtccgtggngtcggtacgttcgggaccgttaagttaaccgaaacctaaacgtacgaacgtaacggtacgacgtaacttaagtttactacgtcgtggcggtcggtacgcgaaggacgtacgtaccactactccgacgtagagtntactacgtcaaggaacgacgagtactatcgtagaccaagacaacacgaaccgtaacggaaccggaacgaccggtacgtacgttacgttacgtacgtcggcgacgacgtacctacgtccgtaacgttacgttacgtttacgtttacggtcgttaccgttacg

SEQ ID NO: 60176 - DNA, 829 bp, Homo sapiens
  misc_feature: GYAE6OF02IG5SH.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgtacttaagttttaaaaggtcgtcctagtgtcgtacggtgccgaggtcgtgggtgggacgggtccgggggaggtcgttggtccgacgggtccggggggtccctaggtaacctctacgtagtaggtcgcgtaggtcgttacgtaggtacttacgacttacgttacgtacggtcgtaccggttacggtacttaacgttaacgtaccggttaccggggtaccccgtaccgtacggttaccggtaccggggaaccgggggtaaacgggtcggtacgggtagggttccggttaccggttacgggtaaccgttaacgttaacggaaaccccgtaaacgtacggaaactaacggtaccgaacgttaacgttaatttacgcggtacgtggtacggtcggtgaacggtacggcgtacgtacctaccgtactcccgttacgaacgtacgtacgtacgtacgttacgaacggtaactaccggtaacggtaccggtaactaccgtaaggtaactaacgaacgggtacaacggtacccgtaaacgggaaaccgacgggtaacccgtaacgggtcgttaacgttacgtcgtaggtccgtaaccgcgtaaccgttacccgttaacggttcgtttaacccggtttagtttaccgtttagtaccggttacggtcccgg

SEQ ID NO: 60177 - DNA, 835 bp, Homo sapiens
  misc_feature: GYAE6OF02HXO39.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttggctgagcttgggttttccttgttgcttattttaaaaggtgtccagtgtcaggtgcagctggttggaggtccgggggaggtcttggtccgagggcccgggggggttaccctaggaaacctcgtcagttggtcgcgaggtctcgttggtacttcactattcaagttcgaccgttcggacttaatacgttaccgttcggggtccccgtccgaacgttcggtacggacccggggtaaaggggcctaggggagttcgggacgtttcgggtaccgttaacttaacggaaaacccctaaaccgtggtaaaacctaaacgggtaaccgacgtaaaaccttaagttttaaacgtcgtaccgtggtacccggttcgggtacgaaccgtaacggtaccggtacgttaccctaaccgacgttcccgttacccgaaggaacggtactacgggttaacttacggaacgtaaacgtaaacccgaggttacccgtaataccgttacgaaacgtaaacgttaacgaaacccgacgtaacccgtaaacggaaaacccgtaaccggggaccgtaaacccgggttacgttaacgttaaccgttacgttacggacggttaacccacgtaaccgttacggtacccggtttaaccgtttacgtttaaaccggtttttacgttttttaacggcgggttttaacccggtaaccccgg

SEQ ID NO: 60178 - DNA, 768 bp, Homo sapiens
  misc_feature: GYAE6OF02JRK28.26.57.F02.1.454.CMB.1.raw
  modified_base (106)..(106): a, c, t, g, unknown or other
  misc_feature (106)..(106): n is a, c, g, or t
  modified_base (125)..(125): a, c, t, g, unknown or other
  misc_feature (125)..(125): n is a, c, g, or t
  modified_base (218)..(218): a, c, t, g, unknown or other
  misc_feature (218)..(218): n is a, c, g, or t
  modified_base (296)..(296): a, c, t, g, unknown or other
  misc_feature (296)..(296): n is a, c, g, or t
  modified_base (568)..(568): a, c, t, g, unknown or other
  misc_feature (568)..(568): n is a, c, g, or t
tcagagactatactcacgaccggtgctcgatttagctcgatatagttgggtttggggctgggagaggagctccagccttgggattcccagctgtctccactcggtnatcggcactgaatacaagngactcacatggagttgggctgagcttgggttttccttggtgcttaattttaaaggtctcagtgtcaggtgcagtctgggtgacggtccggggnggtcttggtccgagggtcccgggggtcctagaactcctctagttggtcgtaccgaggtcttcgtggtactcctaagtnttaccgagttcggtacgtccggtatacgttagtaccggttcggcccgtacctaggttcgtacgggaaccggggtaaggtccggtgggaaggttcgtccggtttacgggaccggtttaaagtaccgtaaaacccgtaaaccggtacgtaacggtaaacccgtaacggaccggtaaactttaaggtttacgtacggtccgttaccgggtacggttcgggtacgacgggtaaaccggttcgacggttaccgaccgtaccctacggtacctaaggngttaagtcgtaagttaccgaagaaccgttacgaccggttaactacgtacgtacgaacgtaacgtaacgtactaacgggtaaccgtaaaccggaaccgtaacggacccgtaaggtacccgttagtaccgttacgtcggtacgtacgactaaccggtcttacgtagtttactttaacggttatttccggtagtccgtaccgg

SEQ ID NO: 60179 - DNA, 789 bp, Homo sapiens
  misc_feature: GYAE6OF02HN8VV.26.57.F02.1.454.CMB.1.raw
  modified_base (610)..(610): a, c, t, g, unknown or other
  misc_feature (610)..(610): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagtttggctgagcttgggtttcctgttgcttatttaaaggtcgtacagtgtagaggtgaccgagtcgtagggtaggtacgggtcccgggggagtcgttaggtaccgacgggtcccgggggtcctagaaacctcgtacgagttcgtacgtcgacgtctcgttaggtactcgtaactagttacgacgtcgtactcggtactaagtacttaacgtcgggtaccctcgtagtaccggtacgaaccggggtaaacggtcgtagggacggttgtaccgttacgggtacgtttaacgtaaaccgaaaccgtaaacgaccgtaaacgtaacggtaaccgacgtaacttaaagtttacgacgtacgtacgtcggttacgaggtaccgtaaggtcctaaggttacccaataccgtaaccgtacgaacgtagtacttacggtaacttacgaacggaaacgaaccgttacggtacgttacgtanacgtaactaaacgtaccgtaacctaccggaaccgttaaaccggtaaaaccggcggtaaccggttaacgggaccgtttaagttaacgttcccgggttagacccgttccgaaagttacccgttacggtaccgtttacgttaacgttaaccgttttcccgtttaagcccggttaggttaccc

SEQ ID NO: 60180 - DNA, 707 bp, Homo sapiens
  misc_feature: GYAE6OF02IMRSC.26.57.F02.1.454.CMB.1.raw
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (500)..(500): a, c, t, g, unknown or other
  misc_feature (500)..(500): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtcgtccagtgtcgaggtgcagtcgtggtggtacggtccgggggagtcgttggtccgacgggtcccgggggggtccctagtaaacctcgttactagtgtacgcgcggacttcgtgacttacgactattcgagtgaccgtcgacttagtactcgtacggtacccgacgtacggttcgacggaccgggtaaaggtccgtgggtagtcgtcgtggtaccgttaagtacgaaccacgagaacgaagtacgcaactagttangtntcgngtcggtacacgtaggcgtaggtaccacgacgtcgtaccgagtaacgtacgttanaacgttacgagaaccggtaaccgacggtcgtacttaccgataacgaagtacgtaaccgagtaacccgtaaacgaaaccgaacgggacttaacccgggtcgttaacgttacgttaacgtaccggtacgaaccggtacaacccgttaggttaacccgtttacgttaacgtttaccgtttaaccggttttgtaccgttaccggtaaccgg

SEQ ID NO: 60181 - DNA, 734 bp, Homo sapiens
  misc_feature: GYAE6OF02IIF0N.26.57.F02.1.454.CMB.1.raw
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgctaattttaaaaggtgtccagtgtcaggtgcagctggtggagtccgggggagtcgttggtccgaggcccgggggggtccctggaaacctctcatgtcgngacggctctggattcactattcagtgactcgctatatacgtcggtccncctagtcgtggaccgggaaggcgtggagtggtcgttcggtaccgtaagttacgaaccaaacgtgaacgtaagtacgacgtattaattagtcgcgtagtccggttcggtcggacgaacgggtcgtacgttaccaacctacgttcctaccgtaagaacgtagtacgtaacttacgaacggaaaccgtaaacgtaccggtacggttaacttacggacgtaaactaaacgtaacgaaaccgtaacggtaaccgtaaacggaaaacccgggtaacggaacccggtaacccggtacgggtttagttaacgttttacggtcggtaacgtacccgaacggtaaccgttacccgtttaccgggttacgttttaacggttttaccgtttttaaccttttttacggtaccggtttaccggtttaacccgg

SEQ ID NO: 60182 - DNA, 878 bp, Homo sapiens
  misc_feature: GYAE6OF02GGE08.26.57.F02.1.454.CMB.1.raw
tcagagactatactcacgaccggtgctcgatttagctcgatatagtttgggtttggggctgggagaggagctccagccttgggattcccagctgtctccactcggtgatcggcactgaatacaagagactcaccatggagtttgggctgagcttgggttttccttgttgcttaattttaaaagtgtccagtgtcaggtgcagtcgtagggtgggacggtccggggggaggtcgtttcgggtaccgtaagggtccccggggggggttacccctaggtaaaaccgttccgtacgaagttggtcggaccgaggtccttcgtagggtacttacgaactacttacgaaggttacgaaccgtcgggtacttaaattacgttaaccggttcggggtacccgaccgtacggttaccgtaccggggtaacccggggaaaaggggtcgttaggggtaacggttgggtaccggtttcgggaccgtttaaggttaaaacccgaaaccgaaaacccgttagaaaccgtaaacggtaaccggtaccgtaaaaccgttaaagttttaccgtacggtacgtcggtcggggttaccgtacggaacgtaaacggtaccgttaacgggttcctaaacgtactaccgtaaccgaaaggtaaggtactagggtacttacgtaacggaaacgtaacgtaaccggtcgttaacgtcctaacggaacgtaaacgtaccgtaaacgacccggttaaaccgaaacggaaaaccggtaacgacccggtaaccggtaaccgtagttttacgtaaccggtcgtaacggaaccgaaagtaccgtaacgtttaaccggttaacgtttacgtttaacgtttaccgttttacgtaagggttcccttaacgg

SEQ ID NO: 60183 - DNA, 922 bp, Homo sapiens
  misc_feature: GYAE6OF02G7QKB.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtagttgggctgagcttgggttttccttgttgcttagttttaaaggtgtccagtgtcaggtcgcagctgggtaggaggtccgggggaggtcgttcgggtccgacggggcccgggggggtccctaggaaacgtcctcgagtgtgcgaggctcgtaggtacttccgaactacttcgaacgttcgaccgtccgggtacttaattaacgttaccggtcggggtccccggtacccgtacggttcccggtaccggggaacccggggggtaaaacggggtccggttaagggggacggggtttcggggtaccgttttccggggtaacccgggtttaacgttaaaaccgggtaaaaaccccctaaaaccgttaggaaaacccgtaaaccggtaacccggtaaccggtaaactttaaaactttaggttacggtccgttacggtccggggtttcgggtaccggtacgggtaaacggtacccggttaccggttaccctaaacccgtaccttacccggtaaccgtaaggtaacggttacgtaacgttacgttaacgaacgggtaaacgaaaccggtaccggttacggttaaccgtacggttacggtaaacctaaacggttaacggaaaccgtaccggaaacccgttaaaccgggaaaccgggaacggaaccgtaaccggggtacgttacgttaacgttccgttaggaccgtaaccggtacgaacccgtttcgttaccggttaccgtttaactttacggtttttaaccggttttaccggttcggttacccgttacccggg

SEQ ID NO: 60184 - DNA, 650 bp, Homo sapiens
  misc_feature: GYAE6OF02GQU09.26.57.F02.1.454.CMB.1.raw
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (436)..(436): a, c, t, g, unknown or other
  misc_feature (436)..(436): n is a, c, g, or t
  modified_base (591)..(591): a, c, t, g, unknown or other
  misc_feature (591)..(591): n is a, c, g, or t
tcagagactatactcacgaccggtgctcgatttagctcgatatagttgggtttgggggctgggagaggagctccagccttgggattcccagctgtctccactcggtgatcggcactgaatacaagagactcaccatggagttggctgagctggtttcttgttgctagttttaaaagtgtccagtgtcaggtgcagcgtggtggacggtccgggggaggtcgttggtccgacgggcccgggggggtccctagaaacctcgtacagtggtgcgaggctcgtggtacttcgacgtattcgagtgacgtcggactagtactacgttcgggtcccnccgtagtcggtacggaccgggaaggtcgtagggngtcggtcgttacggacgttaagtaacgaaccctaaacgtacgaacgaacgtacgacgtaacgtaattacgngtactagcgtacggtgacgaagtacgtacggtacaccgactacgtcaagatacgtgactagaacgtaacgaacgacggtacgtactagtacgaactaaagacgaacgaccgtacgaaacgaaaccggacgtaccgaccgtacgtgtacgttacgngtcgactacgacgtacttcggtactttagttaccgtttagtttcacggttcgtacccgg

SEQ ID NO: 60185 - DNA, 852 bp, Homo sapiens
  misc_feature: GYAE6OF02I4TVW.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggtttccttgttgtcttaattttaaaaggtgtccagtgtcaggtgcagcgtgggtgggagggtccggggggaggtcgttcgggtccgacggggtccccggggggggtaccctacggaaaccttccgttaccagttcggttgccgagggtcctccggtagtacttaccacttacttcgtaggtacgtaccggtcgtacttaattacgtacggtcggtacccacgtcgtcggacgggacgggtaaggtcgtggaggtcggtcggtacggtacgttaacgtaaccgaaacctaacgtacgaacggtaacgtaccgaacgtaacgttaatttaacggtcgtacgtacggtcccggttcgggtacggtaaacggtaccgggtaccgttaaccgttacccaaaccgtttaccgtaccctaaggtaaccggttaagtcccggtaaagttaacctacggtaaacggtaaacgaacccgggtacgttacgttacgtacgtaacgtaaacgttaaagccgtaaaccgacccgtttaaacggaaacgggtaaaccgaacccggggtacgtacccgggttaacgtacgttttacgtaccggtacggttaaccgaacccggttaagtaacccggttaaccgttaccgggttttaacttaacgtttttacgtttttaccgtttaacgggaccgggtttacccttaacgggg

SEQ ID NO: 60186 - DNA, 691 bp, Homo sapiens
  misc_feature: GYAE6OF02II8ZZ.26.57.F02.1.454.CMB.1.raw
  modified_base (444)..(444): a, c, t, g, unknown or other
  misc_feature (444)..(444): n is a, c, g, or t
tcagagactatactcacgaccggtgctcgatttagctcgatatagttgggtttggggctgggagaggagctccagccttgggattcccagctgtctccactcggtgatcggccactgaatacaagagacttcaccatggagtttgggctgagcttgggttttccttgttgcttaatttttaaaaggtgtaccagtgtcgaggtgcagctggtggtaggtccgggggaggtcgttggtccgacgggcccgggggggttccctgtaaacctcttcagtgtcgcgaggtcctcgtggactcactaattcagtcgtacgtcgattagtactacgtcgggcccgacgtcgtccgtacgggaccggggaaggcgtgggagtgggtccgttggaccgttagtaacgaacccaacgacgtaacgtaacggtaccgacgtaactaatttacgngtctagtccggtcggtgacgaggcgtacggtccaccgtatcctacgagacgatacgtacttcgaaagtaacgaacggaacggtacgtagtaccgtagaaccgtaagtacgaacaccgaaccgtaaacgaaacccgaggaacccgtacggccgttaagggtcttacggtcgtcgaccgtacaaccgtccgttaccggttacggttaacgttttacgtttacgttttacgtacggttacccggtcccgg

SEQ ID NO: 60187 - DNA, 673 bp, Homo sapiens
  misc_feature: GYAE6OF02F7WMM.26.57.F02.1.454.CMB.1.raw
  modified_base (94)..(94): a, c, t, g, unknown or other
  misc_feature (94)..(94): n is a, c, g, or t
  modified_base (323)..(323): a, c, t, g, unknown or other
  misc_feature (323)..(323): n is a, c, g, or t
  modified_base (449)..(449): a, c, t, g, unknown or other
  misc_feature (449)..(449): n is a, c, g, or t
  modified_base (614)..(614): a, c, t, g, unknown or other
  misc_feature (614)..(614): n is a, c, g, or t
  modified_base (631)..(631): a, c, t, g, unknown or other
  misc_feature (631)..(631): n is a, c, g, or t
tcagagactatactcacgaccggtgctcgatttagctcgatatagttgggtttgggggctgggagaggagctccagccttgggattcccagctntcctccactcggtgatcggcactgaatacaagagactcaccatgggagtttgggctgagtcgttgggtttttccttgttgtacttaattttaaaagggtctccagtgtcgaggtgcaggcgtgggtgggacggtccgggggaggtcgttgggtccggacgggcccgggggggtaccctagaaacgtctactaagtcgtgaccgaggtctgtaggtctacacgtacttanagtgaccgtggactatatacggtcggaccgacctagtccggaggaccgggaagggcgtagggcgtggtcgtgggtacctagttaaccgaaacctaacgtgaaacgaaggtacgacaatttaattangtcgtgtcgcggtacgacgaaggtctacgtaccactactcgtaccgaaggactgtaagtactacgaacggtaacaacggtaccgtacgtacttcgtaacgaactaaaggtacaaaccgtacgaaccgtaacgaaacggtacggtaacgaaccggtactaacggtntaacgtacacggaccanaccgtgtctaacggttactacgtttacttagtacggtgtacg

SEQ ID NO: 60188 - DNA, 682 bp, Homo sapiens
  misc_feature: GYAE6OF02FHHHL.26.57.F02.1.454.CMB.1.raw
  modified_base (297)..(297): a, c, t, g, unknown or other
  misc_feature (297)..(297): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttgggctgagctgggttttccttgttgctatttttaaaaggtgtccagtgtcaggtgcagctggtggaggtccgggggaggcttcggtccgaggcccggggggtcctcgaaactctcagtgtgcgaggctctggattcgactattcagtgacgtcggntatatacgtcgggtcccgctagtctcggaccgggaaggcgtggagtggtcgtggccgttaagttacgaaaccaaacctgaactaagtaccgacgactaaatttgcgtactgtccggttacggtcggaagaacgggtcgtaacgggtttaccaaccctattacccgtaccgagtaaggtacgtagacgttacgaagggaacgaacccgtacgggtacgtaacttcgtaacgaaccgtaatacggtaaaccgacgtaccgtaaacggaaaccggacggaaaccgaccgggtaccgttaagttaccgttacggcgttacgaaccgtacggtacctacggtccgttaacgttacgtttactttagttttaccgaggtaccgttaaccgg

SEQ ID NO: 60189 - DNA, 950 bp, Homo sapiens
  misc_feature: GYAE6OF02FNKWV.26.57.F02.1.454.CMB.1.raw
  modified_base (333)..(333): a, c, t, g, unknown or other
  misc_feature (333)..(333): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggaggtccgggggaggcgttggtcccgagggtcccgggggggtccctgaaacctctactatgtgcaggtctctaggtattcactattcagtcgactcggattactatacgtcgggtccgaccgtagtcncgggtaccgggtaaagggccgttagggaggttcgggtacgtttacggggtacccgttaagtttaaaccggaaacccctaaaacccgttacggaaaccgtaacggttaaccggtaccgtaaccgtttaaagttttacgacgtacggttcgggtaccggttaccggggtacggaaccggtaaacgggtcccgttacgggtttaacccgaacccgttaaccgttcccgtaacccggtacggtaaacgggtactttaacgggtaacccggttttacggtaaacgggaaaccggttaaacccggttaaccgggggttaccgttaaaccggtttccgtaaccgggtaaacttaaaaacggtccggaaaacccgtaaaggttaccccgtaaaacgggtaaaaaccccgggtaccgggttaaaaccgggtaccccgggttaacccgggtttaacgttaaccgggtttaaccgttacccggttaaccgggaaccccggttaaacggtaaaccccggttaccgggtttaacccccgggttttaacggttttaaacccgggttttttacggtttttaaaccgtttttttacccggggtaacggtttccccggggttttaaaccccggg

SEQ ID NO: 60190 - DNA, 914 bp, Homo sapiens
  misc_feature: GYAE6OF02GJ8NQ.26.57.F02.1.454.CMB.1.raw
tcagagactatactcacgaccggtgctcgatttagctcgatatagttgggttggggctgggagaggagctccagccttgggattcccagctgtctccactcggtgatcggcactgaatacaagagactcaccatgggagtttgggctgagtcgtgggttttccttgttcgcttaattttaaaacggtgtccagtgtctaggtgcagcgtgggtgggaggtccgggggagtcgttggtaccgacgggtcccggggggggttaccctacggaaaaccgtccgtaccgtaagttcggttacgtccgacgggtaccttaccgttaacgggttaacttaccgtaacgttaacgtttaccggtaacggttacggtaaccggttaccggtaaccttaagtaccgttaccggttccgggtacccgtaccgtacggttccggtaacggggtaaccggggtaacgggtccggttacgggtacggggtcggttaccggttacgggttaacccgttaaacgttaaaccggtaaaacccgtaaccgtacggtaaaccgtaaacgggtaccggtaacgtaaacgtttaacgttacgtacgtacgttcggtacggtaccgggtacgaaccgtaacgggtaccgttaccggtaccctaccgtaccgtccgtaacggtaaggtaacgtacgtacgtaacgtaccggtaaacgttaacgtaaccggtacggttaccgtacgtacgtaacggtaacctaacgtaccgtaacgtaaccgtaaccgtaacggtaaaccggacgggtaaccggtacgggtaacgttagttacgttaccgtacggtaacgtaccgtaacggtaaccgttaacggttaccggttaaccgttaacgtttaaccgtttacggttttaccggtaccggttccgtaacccgg

SEQ ID NO: 60191 - DNA, 740 bp, Homo sapiens
  misc_feature: GYAE6OF02I3MZO.26.57.F02.1.454.CMB.1.raw
  modified_base (177)..(177): a, c, t, g, unknown or other
  misc_feature (177)..(177): n is a, c, g, or t
  modified_base (294)..(294): a, c, t, g, unknown or other
  misc_feature (294)..(294): n is a, c, g, or t
tcagagactatactcacgaccggtgctcgatttagctcgatatagttgggtttggggctgggagaggagctccagcttgggattcccagctgtctccactcggtgatcggcactgaatacaagagactcaccatggagtttgggctgagctgggtttcttgtgcttatttaaaggtntccgagtgtcaggtgcagtcgtgggttggaaggtccggggggagtcgttggtccgagggtcccggggggttcctaggaaacgtcgtctagtcgtcgcgagccgtgtggattccagtnttcgacgtgtacgtaccggtcttaacgtacgttacggttccggggtacccgtacggacgttcgggtacggggacccgggggaaagggtcggttagggtaggtacgggtaccggttcggtaaccgtttaagtaacggtaaacccgtaaaaccgttagaaaccgtaaacggtcggtaacctaaacgtaagttactagacgtggtccggttggtacgacgaagtacggtacggtacctacgactaccgtagacgaacgtacttaggtaacttacgaacggtaagaacccgtcggacttagtaccataacgaagtacgtacgacgtacctaacggaaccgacgtaacgaccgggtcgttagtacttaggtacgtaacgtaccgacgtaaacttccgtaagttaccgtttaaacgttcgttttacgtttacggttacgttacggtacccgg

SEQ ID NO: 60192 - DNA, 1033 bp, Homo sapiens
  misc_feature: GYAE6OF02GWS33.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggtttccttgttgcttatttaaaaggtgtccagtgtcgaggtgcagcgtggtggaggtccgggggagcgttggtccgaggccggggggttccctaggtaaacctctcagtgtcgcgacggctcgtaggtacttccgactattccgtaggtcgaccgttaccgggtacttaagtacgttaaccggtccggggtacccgtacccgtaacggttcgtaccggggacccgggggtaaaacggggcgttaggggtacggttacgggtccgttttacggggaccggtttaaactttaaaccggaaaaaccgttaaaaacccggtacggtaaaaccgtaaaacgggttaaccgggaaccgtaaactttaaacggtttttaacgtacgggttacccggtttgggtacccgggtttacgggggtacgtaaaccgggtaaacggggtacccggtttaaacggggtttaaccccctaaccccggttaaccttacccggttaaccccggtaaaaggggttaaccgtaacgggtttaaacgtacccggtttaaaccggaaacgggtaaaccgtaaaaccccggggtaaaccggggttaacccgttttaaacgtccggtttaaaccgtaaacccggtaaaacggttaccggtaaaacccgtaaccggggtaaaccccggtttaaaaccgggaaaaaccccgggtaaacgggtaaaccccgggtaacccgggtacccgtttaacgtttaacgtttaccggttaacggtaacccggtaaccggtaacccggtaaactttaacccggttaccccgggttttaaccgtttaacccgggttttttaacgttttaacccggtttttttacgtaccgggttttaccccggggttaacccgg

SEQ ID NO: 60193 - DNA, 714 bp, Homo sapiens
  misc_feature: GYAE6OF02FNQNJ.26.57.F02.1.454.CMB.1.raw
  modified_base (193)..(193): a, c, t, g, unknown or other
  misc_feature (193)..(193): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (418)..(418): a, c, t, g, unknown or other
  misc_feature (418)..(418): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagttgggctgagctgggttttccttgttgctatttaaaagtgtccagtgtcaggtncagctggtggaggtccgggggaggcttgggtccaggccgggggggtccctgaaactctcatgtgcgaggctntggnttcacattcagtgacctcggctatatacgtcgggtccgcctagtctcgggaccgggaaagggtccgtgggtagtgggtccgttggaccggttagttaacgaaacccgaaaactcggaaactaacggtaaccgacgtaactaagttttancgtcgtggtaccggtcgggtagtaccgaaggtccgtaggttaccaccgtatcctaccgagtacgatagaattcgaacggtaacgtaaccgtaacgggtacgtacgttaccgtacgaaccgtaaaagtaacggaaaccgtacgtaacccggaaacgggaaaaacccggtacgggaaccgtaaccgggcccggttagttacgtttaccgtaggtccggaacgtaccgtaaccgttacgttaccggttacgtttaacgtttaaccgtttacgtttttccgtaggtttccggttacccgg

SEQ ID NO: 60194 - DNA, 764 bp, Homo sapiens
  misc_feature: GYAE6OF02GP2UR.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggaggtttgggctgagtcgttgggttttccttggttgacttaagttttaaaagtgtccagtgtcaggtgcagcgtgggtggaggtccgggggaggtccgttggtccgacgggccgggggggtccctaggtaaactctcatgtcgcgaggtctcgttaggtacttaccgacgttacttacgaaggttcgaccgttcggacgttaattaacgtaccggttccggggtacccgtaccggtaacggttccgtaccggggaacccgggggaaacggggtccgggtacggtcgggtccggttacggtaccgttaagttaaaccgaaacctaaccgtacgtaacgtaaagaccggaacgtaactaagtttaacgtcgtcgttcggcggttacggtacacggtaaacggccgttacggtaccacctaccgtcgtaccggtaagagtagtacgtacgttacgaacggtaacgaaccggacgtacgttacgtcgtacgtaactaagtaacgacgacgtaaccgaacgaaacggacgaaccggtcgtacgtacgtttacgacgttcgaccgcgtaacgaccgttacgtaccgttacgttaacgtttaacgtttcgtttacgtacggttccgtacgtacgg

SEQ ID NO: 60195 - DNA, 842 bp, Homo sapiens
  misc_feature: GYAE6OF02JLRF3.26.57.F02.1.454.CMB.1.raw
  modified_base (196)..(196): a, c, t, g, unknown or other
  misc_feature (196)..(196): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgtggttttccttgttgcttattttaaaggtgtccagtgtcaggtncagctggtggagtccgggggagcgttggtccgaggccggggggtcctagaactctcgagtgtgcaggccttcgtggtattccactagttcgagtcgacgtacggtctaagttattaccgtgggtccccgctacggttccgtacgggtaccgggaaagggtccgttgggaggtcgggtccgttacgggccgtttaagttaacggaaaaccctaaccggttacgaacctaaacggtaccgtacgaaacgtttaagttttacgcgttaccgtcgggtacccgttacgggtactaaccgggtaacgtccggtaaccgggtttaccgtaaccgttacgttacccgtaacccggtaacggtaacggtaagttaccggtaacgtttaccgaaacgggtaaaccggtaaaccgggtaaccgggttaccgtaaacgttccgtaacggaaccgttaaaacgttaacgtaaccgtaaaccgtaacccgtaaaccggtaaaacccgaaacgggtaaccggtaacccgggtacccgtttaacggttaccgtttaccggtaacggttacccgacgttaaccgaaccgttacgtttacccggttaacgtttaccgttaaaccggtttacgttttttaaccggtacggtttaccgtacccgg

SEQ ID NO: 60196 - DNA, 880 bp, Homo sapiens
  misc_feature: GYAE6OF02HGX8K.26.57.F02.1.454.CMB.1.raw
  modified_base (129)..(129): a, c, t, g, unknown or other
  misc_feature (129)..(129): n is a, c, g, or t
tcagagactatactcacgaccggtgctcgatttagctcgatatagttgggtttagggggctgggagaggagctccagccttgggattcccagctgtcctccactcggtgatcggcactgaatacaaganactcaccatggagtttggctggagtcgttcgggtttttccttgttgactttaagtttttaaaaaggttcgttacccgaggttcgttcgaggtcgcacgtcgtgggtgggtagggtcccggggggtaggtacgttcgggtaccgacgggtcccgggggggttaccctacggaaacctccgtacagttcggtacgacgacgggtcctacgttggtactttcgaactaatttacgaggttacggaccttcgggtacttaagttacgtaccggtagggtcccgaccgtacgtacgttcgggaccgggggaaaggtccgtagggtaggttacgggtcggtttacgggtaccgtttaacgttaaacggaaaccccttaaaccggtagaaacccgtaaaggtacgtaaccgtaaaccgtttaactttacgtacgtcccgttacggttaccgggttcggtaccgggtaaccgtaacggggtcgtaaccggttacctaaccgtctaccctaacccgtaagtacggtacgttagtaacgttaacgaacggtaacgtaacggtaccggttaccgtaacgttcgtaacaacgtaaacgtacggtaacaaccggtacgttaaaccggaaaacgaccggtaccggaacggttaccgtacggtttaacgtacgttcggaacggtacccgaaggtaaccctaccggtaccggtttaacgttaccgttttaacgtttaaccgttttacccgtaggttaccggtaccgg

SEQ ID NO: 60197 - DNA, 759 bp, Homo sapiens
  misc_feature: GYAE6OF02GXULP.26.57.F02.1.454.CMB.1.raw
  modified_base (291)..(291): a, c, t, g, unknown or other
  misc_feature (291)..(291): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtgtccagtgtcaggtgcagctggtgggaggtccgggggaggtcgttggtccgacgggcccgggggggtccctagaaactctcagtgtgcgaggctctggacttcactnttcagtgtactcggactatatacgtcgggtcccgccgtacgtcgtcggaccggggaaacgggtcgtagggagtcgggtcgttacgggtccgttaagtaaccgaaaccgtaaaccgtcgaaccgtaaaggtaccgacggtaactaaacgttttagcggtctacggtcggttcgggacgtaccgtaaggggtcctaacgggttcccaaccgtcttaccctacccggaagaggtaactcggtaacttaccgaaggtaaaccggtaaacgacgggttacctaacgttccgaggtaaaccaaagttaaccgaaacgacgtaaccggtaacggtaaaacccggaacgggaacccgtaacccgggggtaccgtagttaccgttacggtcggttaacgaccgtagtaacccgttacgttcccgttaacgtttaacgttaccgttttacgttttaccgtaggtttacccgtaaccgg

SEQ ID NO: 60198 - DNA, 838 bp, Homo sapiens
  misc_feature: GYAE6OF02JGRI8.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccataggagtttgggctgagcgttgggttttcctgttgcttaattttaaaaggtgtcctagtgtcaggtgcagctggtggacggtcgggggagtcgttggtaccgacgggtcccgggggggtcccttaggaaaccttctacgtacgtgtacggtcgaggtccttacgtggtacgttaccactaacttaccgtaagtcgtaccgttaggtccttaatacgttaccggttcggtacccggcccgttacggtaccggtacggaaccgggggtaaacggggtcgtaacggggtacggttcggtccggttacgggtaccggttaacgttaaacggaaaacccctaaacccggtacgaaacggtaaccgttaacggacggttaacttaaacgttttcggacggtctcgggtaccggtcgggtacgtacgggacggtccgtaggtaccctacctacgtaccgtacccgataacgggtacgtagttacgttacgaacggtaacgtaaccggacgttaccggtactaccggtacgaaacgtaacggtaacaccggaagttacccggaaaacgggtaaaccgaccggaccgttaacggacgttacggttacgtacggacggttaaccggacccgttaaggaaaccgttccggtttacgttaaccggttttacgttaaccggttttacctttaccggttacggttacccggtaaccgg

SEQ ID NO: 60199 - DNA, 885 bp, Homo sapiens
  misc_feature: GYAE6OF02F5ZUN.26.57.F02.1.454.CMB.1.raw
  modified_base (119)..(119): a, c, t, g, unknown or other
  misc_feature (119)..(119): n is a, c, g, or t
  modified_base (413)..(413): a, c, t, g, unknown or other
  misc_feature (413)..(413): n is a, c, g, or t
  modified_base (766)..(766): a, c, t, g, unknown or other
  misc_feature (766)..(766): n is a, c, g, or t
tcagagactatactcacgaccggtgctcgatttagctcgatataggttgggtttggggctgggagaggagctccagcttgggattccagctgtctccactcggtgatcggcactgatanaagagactcacatggtagttggctgagtcgtgggttttcttgttagacttaagttttaaaacggtcgtccgtagtacgtcgaggtgcgagcgtggtgggtacggtccgggggaggtcgtttcggtccggtacggggcccgggggggttccctaggaaaacttcgtccgtaagttcggtacgacgacgtcgtacggtcggtacttactactacttacggtacgttacgacgtcgtagttacgtacgtaccggtcggtccgaccgtgttcgacgggaccgggttaaggcggtaggnggtggcgttgggtaccttagtaacgaacgtaaccgtagtaacgtacgtacggtaccgtaagttaaagttctacggtacttcgggacccgtttgggaccgacgggtaacggacgtaacgggtacctacccgtacggtttaaccaggtaacgaaggttactaacgtggtttaaaccgtaacggtaaacgaaccggttaaccgggttaccttaacgttaccgttaacgggtaaccttaaaacgggaacgtaaacccgtaacgggttaaccccggtaaaaaccgggttaaccgggaaaccgggttaaacccggttacccggggtttaacggtttacccgtttaacgggttttaaccncggggttttaaaccgacccggtttaaacggcccgttaaacggttttaccgttaccgggtttaactttttacccggggtttttacccttttacgggtaccgggtttaccgtttaacccgg

SEQ ID NO: 60200 - DNA, 848 bp, Homo sapiens
  misc_feature: GYAE6OF02GLX5F.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagcgtggtttcgtgtagtcgtatttaaagtgtcagtgtcaggtgcagctggtggacggtccgggggaggtcgttggtccgagggtcccgggggggtccctaggaaaccttcctcgagttgtcgcgaggtccgtgtcggtactttacacttacgttacgacggtacgtaccgtcggtacttaagtacgttaccggtccgggtcccgtcccgagttcccgtacgggaccggggaaacgggtccgtagggtacggtcgggtcgttacgggtaccgttaagttaacgaaaccgaaaccgtagtaacgaacgtaacggacctaacgtaattagtacggtcgtggtccgtcggtacgtacgaacggacgtacggttaccaaccgttactaccgttacgaggtactgtacgtacgtaccgttaaggaacgtaaacccgtacggtacggttaacgttacgtacgaaacgttaacgaacgttaaacccgtacgtaacccgtaacgggtaaaaaccgggtaacccggtaaccgggtaaccggttaacccggtttaaccgggtttacgtttaaccggttacggtaaccggtaaccggtaaacggtaaccgtttacccggttaccccgggtttacggttttaaaaccggttttaccggtttttaaacggttttttaccggtaccggggttttaccccggtttaaccccggg

SEQ ID NO: 60201 - DNA, 691 bp, Homo sapiens
  misc_feature: GYAE6OF02FMQHQ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggagcttggtccaggccgggggggtccctagaactctcatgtgcaggctcgtggattcacacttcagtcgactcggctaatatacgtcgggtcccgccaggtctggaccgggtaaaggggctgggagtggacttgggaccgttatacggaacctaaacctggaaccaacgggtacgacgaactaaagttttacgcgtcgtgtaccgggttcggtacgacggtaacgggcgtaggttaccgaacctactccttacccgaaggtaacggaattcggtaacgtttacaacggtaaacgaacgtaaccggtacgtacgttccgtagaacgtaaacgtacgtaaacgacgtacctaacgggaaaaccggacggaaaccgacgggtacccttaggttacgttacgtaggtacggaccaacggtacaaccgttcgttaaccggtatttaaccgttagtttttaccgtacggttccgtaacccgg

SEQ ID NO: 60202 - DNA, 628 bp, Homo sapiens
  misc_feature: GYAE6OF02JTZ8V.26.57.F02.1.454.CMB.1.raw
  modified_base (277)..(277): a, c, t, g, unknown or other
  misc_feature (277)..(277): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
  modified_base (511)..(511): a, c, t, g, unknown or other
  misc_feature (511)..(511): n is a, c, g, or t
  modified_base (626)..(626): a, c, t, g, unknown or other
  misc_feature (626)..(626): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttggctgagtcgtggttcgtgtagctagtttaaacgtgtcagtgtacaggtgacagtctggtggaggtccggggaggtctggtccgacgggtccgggggtaccctaggaaccgtctcgaagtcgtgcgacgtcgtcgnggtactcacgtacttccgagtacgaccgtggtactagtagtcgtcggtaccgctagtccgtcgacgggaagtccgaggtacgtgcgtgtcgtaactacgaactaccgtgaacgtacggataccgaacgttatagtctagtcgtcggtcgtagacgacgtcggtacgttaccgaactctacgtcgaaagcgtaacgngttaccagacgtacgacgcggtaatntaccggactaanacgtacacgtaacgtacgaacgaacgcgacggtcgacgttacgttactcgaacgcgtactaacgtacgttacgtcgttaacgtttacgttaccgttaggtacgttacggttaccncg

SEQ ID NO: 60203 - DNA, 951 bp, Homo sapiens
  misc_feature: GYAE6OF02GL1WZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccagtggtagtttgggctggagtcgttgggttttccttgttgtctttaagttttaaaaggtgtccagtgtcgaggtgcagcgttgggtgggacgggtcccggggggaggtccgtttagggtcccggacggggtccccgggggggggttaccctacggtaaaacccgttccgtccgtaagttcgcggaccgacggggtcctcggttggtacgtttaccaaccgtattttaccgagttcgaaccgttccgggttacttaagtaaccgttaccggttacggggtccccgtacccgtaacggttccggaaccgggtaaccccgggggaaaaggggtccgtacgggggtacgttgggtccgttcggggttaacccgttaaacggtttaaaccggaaaaacccgttaaaccccgtacggtaaaaccgtaaaccggtaaccgggtaaacctaaacgtttaaacgtttttaagacgttaccggtcgggttaccggttacgggggtcggtaacccgggtaaagggtacccgggttaacggtttaccccaaccccgttaaacgttaccccgtaaccgaaggtaaccgttagtaaccgttaagttacgaaacggaacgtaaaccggtacggaccgttacgtacgtaaccggacttaaaacggtaacgtaaccgaccggtaacctaaacgggtaaacccgaacggtaaacccggaccgggttaccgtagttaccgtttacttacgggaccaccggtaaccggtacgtaaccgtttccgttaacgtttaccggtttacttttacgttttacggtagggttacccgtaacccgg

SEQ ID NO: 60204 - DNA, 766 bp, Homo sapiens
  misc_feature: GYAE6OF02GPDA6.26.57.F02.1.454.CMB.1.raw
  modified_base (316)..(316): a, c, t, g, unknown or other
  misc_feature (316)..(316): n is a, c, g, or t
tcagagactatactcacgaccggtgctcgatttagctcgatatagttgggtttgggctgggagaggagctccagccttggattcccagctgtctccactcggtgatcggcactgaatacgaagagactcaccagtggagtttggctgagtcgttggttttccgttgttgtacttaagttttaaaaggtcgtccgtaagtgtacgaggtcgcgtagcgtggtaggaggtccggggagtcgttggtccgacggtccgggggtcctacgtaactccgtacgagtggtcgacgacggtctcgtggtacttacctaacgtnttacgagtcgacgtcggtattactcgtacgtcggtacccgtcgtagtcgtacggtacgggaaggtcgtgggtagtcggtcgttggaccgttaacgtaacaaaacccgtaaaccgtagtaacgtaacggtacaacgtaactttaagttacgtacggtcgtacggtaccggttacggtacgacgtaacggtcgtaacgttaccgtaaccgtaccgtaccgtaccgtacgtaacgtagtacgtaacgtacgtaacgtaaacgtaacgtaacggtacgttacgtacgtaacgtaacgtaacgtaacgaacgacgtaaccgtaacgtaaaccgtaaccggaccggtaacggtacgttacgttacgttacgacggttttttttttacgaccgtaccgtaccgtacgtaccgttacgttaccgtttacgtttacgtttcgttacggtacgttaccgg

SEQ ID NO: 60205 - DNA, 740 bp, Homo sapiens
  misc_feature: GYAE6OF02FWF7V.26.57.F02.1.454.CMB.1.raw
  modified_base (183)..(183): a, c, t, g, unknown or other
  misc_feature (183)..(183): n is a, c, g, or t
  modified_base (197)..(198): a, c, t, g, unknown or other
  misc_feature (197)..(198): n is a, c, g, or t
tcagagactatactcacgaccggtgctcgatttagctcgatatagttgggtttggggctgggagaggagctccagccttgggattcccagctagtctccactcggtgatcggcactgaatacaagagactacaccatggagtttgggctgagctgggtttccttgttgctattttaaaaggtntccagtgtcaggtnnagctggtggagtccgggggagcttggccaggccggggggtccctagaacgtctcatgtgcccgaggtctcgtggtacttcgactacttacgtagttcgacgttcggcttactacttacggtcgggtcccgacctaggtaccgtcggaacccgggggtaaagggtcgtaggggacgtagggtcgttcgggtaccggttaacttaacgaaaccgtaaccgtgaacgaaggtacgacgtaactaactttagcgtactggcggttcggtacgacgaaggtcgtacggttacacctactccacgagagtacgtataccgtacgaacggaacgaaccgtaacgggtcgttaacgtacgtacggaacgtaaacggttacgaaccgtaaccggtaccgtaaaccgggaaaacccgcgggaaaccgtccgggttacccggttaattaacgttacggtacgtaccggaacctaacgaccgttaacgttacccggttacgtttaacgttttaccggtttagtttttacccggaccggtttaccggttaacccg

SEQ ID NO: 60206 - DNA, 879 bp, Homo sapiens
  misc_feature: GYAE6OF02JW5UU.26.57.F02.1.454.CMB.1.raw
tcagagactatactcacgaccggtgctcgatttagctcgatatagttgggtttggggctgggagaggagctccagccttgggattcccatctgtctccactcggtgatcggcactgaatacaagagactcaccagtggagtttggctgagtcgttgggttttccttggttgtcttaagttttaaaaggtgtcctagtgtcgaggtgcgagcgtggtggacgggtccgggggaggtcgttcggtccggacggggtcccggggggtcccttaggaaactccgtctagttggtacgcgtaggtcctcggttaggtaactttcaaccgttaagttcgtacggttagtaacccgtcgggttaccttaagttacgttaccggttccggggtaccccgaccgtacggttccggtaaccggggtccgggggtaaagggtccgtaggggttacggtcggggtccgtttacgggtacccggtttaaagttaaccggaaaaacccctaacggtaccggtaaacgtaaacggtacgtaaccgtaacgttaaacgtttcgaaggtccgtaaccgggtacgggtaccggtacggtaaccgggtaaacgggttccggtaaccggttaaccgtaacctacgttccccgtaacggaaacgtaagtacggtaagtaagttccgtaaacggaacgtaaacgtcggtaaccgtagtcctaacggtaacgtaacgtaacgacgtaccgggtaaccgtaaacggtaaccggacggaaccgttaacgggtaaccgttacgttacgtacggttcgacggtaacctacggtaaccgacgttaccggttaacttttaaccggttaacggttttacttttaccggtacgggttccgtttaacccgg

SEQ ID NO: 60207 - DNA, 823 bp, Homo sapiens
  misc_feature: GYAE6OF02HFT9L.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaactacaagagactcaccagtggagtttgggcttggagtcgttgggttttccttggttcgtcttaattttaaaggtgtaccagtgtcagggtcgacgagtctgggtgggacggttccgggggaggtcgttcgggtccgacgggcccgggggggttccctaggtaaacctccgtacgtaagttcggtaggccgtacggcttcgtacggtactttctaacgtattaccgaggtgtaccgtcggtacttaacgtacgtcggttcgggtacccgcctaagggtccgtacggtacccggggaaaggtcggtaggaggtggttacggtgggtccgtaattaaccggaaaccgtaaccgtacggaactacgggtaacgtacgaaaactttagtttacgtacgtcgtacggtcggttacggacgtacggaacgtacggtaacggttactaacccgttacgtaccttacggaactacggtaaacgtacgttaacgtaaccggtaaggaaaaccgggtaacgtaccgggtacggttaactaccgtacggtaaactaaaacggtacgaaacggtacgtaacccggtaaacgggaaaacccgtacgggaacccgtacggtaccgttagtactttaccgggtacgtacggaccgtaataccgaccgtttaccgttacgtttaactttaccggttaccgttttacgtcggttacgtaccgg

SEQ ID NO: 60208 - DNA, 809 bp, Homo sapiens
  misc_feature: GYAE6OF02F4HMZ.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcacccatggagttgggctgagctgggttttccttgttgctatttaaaggtgtccagtgtcaggtgcagcgtggtggaggtccgggggaggtcgttcggtcccgacgggtcccgggggggtccctaggtaaactcgtacgtagtgtgaccgaggccttcgtaggtacttcactattcgtagtcgtaccgttcggactaattaattacggttcgggtcccgacgtacggttcgtccgggaccggggaaagggtccgtgggtagtcgggttcgttacgggtaccgttaaggttaaccgaaaacccgtaacgtacgaacgtaacgtaacgtacgtaacttaacgtttacgacgtccgtacggtaccggttaccgggtgaaccgtaacggtaccgtaacgtttaacccgaacttacccgtacctacggaaacggtacgtacgtaacgtagttaaccgtaaggaaaccggtaaccctacggggttaccttaactccggacgtaaactaaaccggtacgaacccgtaccggtaacccgttaacggaaaaccgtaccggaaccggttaccgtccgttaagttacccgttagttaccggaacgttacccgaacgtacccgttaacgttaccccggttattaaccgggttttacctttaaagttttccccggtaggtcccgttaacccgg

SEQ ID NO: 60209 - DNA, 813 bp, Homo sapiens
  misc_feature: GYAE6OF02GNI3Z.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggctgagtcgttgggttttccttgttgtacttaattttaaaaggtgtccagtgtcaggtgcagctggtggaggtccgggggaggtcgttggtccgagggtcccgggggggtaccctggtaaaccgtcctcagtgtgcgaggcctgtggacttcacgtattcagtgacgtcggactatactacgtgggcccgtcgagttcgcgggaaccgggaagggtcgtagggacggtggtaccggttgggacccgttagttaaaccggaaaccgaaaccttcggtaaaaccgtaaacggtacccgaacgtaaacctttaaagttttaacgtggtacgttacgggtcggtttaccggggagtaacccgggtaaggtaccgtaaaccggttacccgtaaccgtacgttaccgtacccgaaaggacggttaacgtaggtaacttaccgaacggtaaacggaccgtaaacggttccgttaactaccgtacggtaacgaaacgtaccgaaaccgaaccgaccggttaaacggaaaaccggtaacgtaaacccggaccggttaccgttagttaacgtttaccggtacgtcggtaaccgtaccgtaaccgttaccgttaccggttaaccgtttacggtttaaccgttttacgtttttaaccggtaccggttaccggttaacccgg

SEQ ID NO: 60210 - DNA, 802 bp, Homo sapiens
  misc_feature: GYAE6OF02H7W2U.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcacatggagtttgggctgagctgggttttccttgttgcttaattttaaaggtgtccagtgtcaggtgcagctgggtgggaggtccgggggaggtcgttgggtccgagggcccggggggggttccctaggtaaaccgtcttccagttgtcgcgacggctcgtggtacttccaactattcaagtgtaccgtcggactaattagttaccgtcgggtcccgccgtacgttccggtcgggacccggggaaacgggcgtagggaggtcgggttcgtcgggtccgttaagttaaccggaaaacccaaacccggttacgaaaccgtaaacggtaccggaaccggtaactttaacgtttagtcggtacgtcggtcggttcggggtacggacggtaacgggtccggtaacggtttacccaacgttacctccgtaacccgagtaacgtacgttacggtattacgaaaggaaccggaaaccgtcgggtaacgttactacggtaacgtacctaaaagttacggaaacctaccggacccgtaaacccgggaaaacggaccggaaccggtaaccggtccggtagttacctttaggtaccggtccgtaaccgtacggtaacttaccgttacccgttacgttaacgttttaccgttttaacgtttttcggaccggtttccgttaacccgg

SEQ ID NO: 60211 - DNA, 822 bp, Homo sapiens
  misc_feature: GYAE6OF02IM7QP.26.57.F02.1.454.CMB.1.raw
  modified_base (184)..(184): a, c, t, g, unknown or other
  misc_feature (184)..(184): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagcttgggttttccttgttgcttaattttaaaaggtntccagtgtcgatgtgcagtcgtggtggagggtccgggggaggtcgttcgggtccgagggcccgggggggtccctaggaaacctcgtacatggtgcgaggtcttcgtaggtacttcgaactacttacgtagtacgaccgtacgggtacttaagttaacgttaccggttacgggggtcccccgtacccgtacggttacccgtacgggggtaacccgggggaaaacgggggtcttacgggggaggttcgggtaccgttaagggtacccggtttaagttaaaccggaaaccctaaaaaccgtacggaaacctaaaggtaccgtaacgtaaactttaaagttttaagtacggacgttacggtccggttacgggtacggtaacggtaaaccggtaccgtaacgggtttaaccctaaccgtaacgtacccgtaccgtaaacggtacgtaacgttacgtacgttaacggtaaacgtaacgtaaccggaaccggtacgtaccgtaccgtacgtaacgtaaagttacgaaacgaccggtaacccgtaacggaaaaccggaacggtaaccgacggtaccgttagtacgttacgagtacgacgtaacgactacgtccttagtacgttacgtttacgtttctagttaccgg

SEQ ID NO: 60212 - DNA, 711 bp, Homo sapiens
  misc_feature: GYAE6OF02HAOD3.26.57.F02.1.454.CMB.1.raw
  modified_base (185)..(185): a, c, t, g, unknown or other
  misc_feature (185)..(185): n is a, c, g, or t
  modified_base (571)..(571): a, c, t, g, unknown or other
  misc_feature (571)..(571): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttccttgttgcttaattttaaaaggtntccgtagtgtcaggtgcagcgtggtggaggtccgggggaggtcgttggtccgagggtcccgggggggtccctagaaacgtctcagtgtgcaggctgtggtattcacgtattcgaaggtgaccgtggtctaatacgtaccggtccgggtcccgtccgtaggtccgtacggggaccgggggtaaaggcggtgggaggttcggtcgttacgggtccgttaagttaaaccgaaacctaaacccgtagaaacgtaaggtacccgagtaacttaagtttagtcgtcgtaggtccgttggtcgacgtaacggcgttacggtccaacctcgtcctacggatagtaagttgtaacgttaggaacgaacggacggtacgtacgtgtacaacgtaanaacgtacgaacgtaccgtacggaaaaccggaaccgggaaccgtaacggtacccggttattaccttagtacgtcgtacgacacgtacttccggtacgtttaacgttacttttacgtttcggttacttacggttcgtaacgg

SEQ ID NO: 60213 - DNA, 828 bp, Homo sapiens
  misc_feature: GYAE6OF02FK6LG.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatgggagtttgggctgagcgttgggtttttccttgttgtcttattttaaaaggtgtccagtgtctaggtgcagcgtgggtgggagggtccggggggaggtcgttcgggtccgacggggtcccggggggggttccctaggaaaccttcgtacctagtcggtacgcgaggtccgttcgtggtacttcgactacttcgagttcgacgtcggtacttattacgttacggtccgggtcccgtccgtacggtcggtacgggaccggggtaaacgggcgtaggggtacggtcggtcggttcgggccgttaagttaaccggaaacctaaaccggtcgaacgtaacggtaccgaccgtaactttaattacgtgtacgttcggtcggtccgggtacgtacgaacggtccgtacggttaccaccgtacttcccgtacgtacggacgtacgtacgtacgtacgaaggtaaccgaaaccggacggtaccgttacgttacgtaacgtaacgtaaacggtacgaaaccgtaaccgtaaccggaacgggtaaaacccgggacggaacccgtaacggggttacccgttaggttaacccgttacggtccgttaacggtaccggaaaccgtacgttaacccggttacccggtttaacgtttacgttttacccgttttacggttttaccgggtttaccggttcccggttaaccgg

SEQ ID NO: 60214 - DNA, 746 bp, Homo sapiens
  misc_feature: GYAE6OF02G0IYD.26.57.F02.1.454.CMB.1.raw
  modified_base (319)..(319): a, c, t, g, unknown or other
  misc_feature (319)..(319): n is a, c, g, or t
tcagagactatactcacgaccggtgctcgatttagctcgatatagttgggtttggggctgggagaggagctccagccttgggatttccagctgtctccactcggtgatcggcactgaatacaagagactcaccatggagtttgggctgagctgggttttccttgttgcttattttaaaaggtgtccagtgtcaggtgcagctggtggaggtccgggggaggcgttgggtccgagggcccgggggggtccctagaaactctcatgtgcgaggctcgtggattcacattcagtcgactcggactatatacgtcgggtcccnccgagtcgtggaccggggtaaggcgtagggaggtggtcgttagggtaccgttaagttaacgaaaccctaaaccgtaggaaactaacggtaccggacgaacttaaatttacgtcgtaccgtggtacggttcggtacggtacgaaacgggtccgtaacgggttaccctaacccgtaagttacccgtaccgtaacggtaagtacttaggtaacttacgaacggtaacgaaccgtaccgggtacttacgtaccgtagaactaaacgtacgaaccgtacgtaaccgaacggaaaaccgaaccgggaacctaaccgggtaccgttagtaccgttacgtacggtaccgtaacgtaaccgaccgttaccgttacccggttacgtttaacgtttaccgttttaacggtttttaccgtacgggttcccgttaacccg

SEQ ID NO: 60215 - DNA, 871 bp, Homo sapiens
  misc_feature: GYAE6OF02F65KO.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatcggaggttgggctggagtcgttgggtttttcctggttcgcttaagttttaaaaggtcgttccaggtgtcagggtgtcagcgtcgggtgggacgggtaccgggggaggtccgtttagggcccgtacgggggtcccggggggggttccctaggtaaaaccgttcctacctagttcggtcgtcggaacggtcgttaccgtacgggtacttcaacgttacttacgtacggtacgtaaccggttccgggtacttaacgttacgttaaccggttccggggtccccgtaccggtacgttaccggttcgggacccggggtaaacggggcgtggggacggttcggtaccgtagggtacccgttaagttaaccgtaaaccgtaaacgttacggaacccgtaaacgtaccgggtaccgttaaaactttaaactttacgtacggtaccgtttagggcccggttagggtacgtacgtacgggtaccggttacgtaaccgtacccgttaggtacctacccggaagtaacggtatacggttaacgttacacggtaaacggaacgtaaccggttacgtatacctagggaacttaacgaacgggaaactaccgtaacggaaccgtaaaccggaacggtaccggacggttaaccgtaggttataccgtggtacgtaacgaccgtaaccgtacgtttaaccggtacggttttaacttaccggttttaacgtttcggtacggttacccgttaccgg

SEQ ID NO: 60216 - DNA, 860 bp, Homo sapiens
  misc_feature: GYAE6OF02H7MQY.26.57.F02.1.454.CMB.1.raw
tcagagactatactcacgaccggtgctcgatttagctcgatatagttgggtttggggctgggagaggagctccagccttgggattcccagctgtcctccactcggtgatcggcactgaatacaagagactcaccatggagtttgggctgagcttgggttttccttgttgcttaattttaaaaggtgtccagtgtcaggtgcagctgggtgggaggtccggggggaggtcgttgggtccgaagggtccccgggggggggttacccttacggaaaacccgttcgtaccgaagttggtacggacgtacgggtccttcgtagggtaacttacaacgtaacgtttaccgaggttcgaacgttcgggaccttaaagttacgtaaccggttcggggtcccgaccgacggtttccgtacgggaacccggggtaaagggcgttagggaacggttgggtacggttgggtaacccgttaaagttaaaaccggaaaaccccgttaaaaccgtacggaacgtaaaacgggtaccgaacgtaaacgttaaatttacgacgtcgtagtccgtacgggtagtacgtaaacgggtcgtaacggttacctaaccgtactacctacccgaagtagtaacgtagtaacttagaacgtaaacgtaacgaccggtaagttaccgtacgtaacgtaactaaaacgacgtaaaccgaccgtaaccgtaaacgggaaaccggtaaacgggaaccgtaaccgggtaccgttaacgtaaccgttttaacgcggttaaccgaccgtaacggaacccgttaccgtacccggttaacgttaacgtttaaccgttttaaggttttttacctaacgggttaccgttaaccgg

SEQ ID NO: 60217 - DNA, 877 bp, Homo sapiens
  misc_feature: GYAE6OF02GIE6U.26.57.F02.1.454.CMB.1.raw
  modified_base (666)..(666): a, c, t, g, unknown or other
  misc_feature (666)..(666): n is a, c, g, or t
  modified_base (679)..(679): a, c, t, g, unknown or other
  misc_feature (679)..(679): n is a, c, g, or t
tcagagactatactcacgaccggtgctcgatttagctcgatatagttgggtttggggctgggagaggagctccagccttgggattcccagctgtctccactcggtgatcgacactagaataacaagagactcaaccagtggtagtttgggctgagtcgttgggtttttccgttgtttagtactttaagtttttaaaaggtcgtaccgagttcgtacgtaggtgcgagtcgtagggtggtacggtcgggggaggtcgttacggtccggacgggccgggggggttaccctacggtaaaccgttcgtaccgtacggttcggttcggacgtggtaccgttcggttcggtacttaccgtacgttaatttacgtacggttacgtaaccgttcgggtacctttaagttacgttaccggttaccggggttacccgtaccgtaacggtttccggacggggttacccggggaaagggtccggttaggggtaacggttccgggtacggttttaccgggtaccgtttaaacggttaacgtaaaacccgttaaaccggttacgtaaacggtaacggttaacgacggttaaaccgttaaaggtttacgttacggaccgtcgggttacccggtaggtaccggtaacgaacggtacgtacggttacaacgtctacgtacganaacgtcgtaagtntaccgagaaccgtacggacggtactacgtacttacggaactaagtaacgaaccgtaaccgggtataaacccgggaaccgggaaccggaccggtaacggtacggttaaccgttacgtaacctaggtaaccgtaccgtaacgtacgtaccgttagtaccgtttaactttacgttagttttaccggacgttcggtaaccgg

SEQ ID NO: 60218 - DNA, 770 bp, Homo sapiens
  misc_feature: GYAE6OF02FHFET.26.57.F02.1.454.CMB.1.raw
  modified_base (125)..(125): a, c, t, g, unknown or other
  misc_feature (125)..(125): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
  modified_base (577)..(577): a, c, t, g, unknown or other
  misc_feature (577)..(577): n is a, c, g, or t
tcagagactatactcacgaccggtgctcgatttagctcgatatagttgggtttggggctgggagaggagctccagccttgggattcccacgctgtctccactcggtgatcggcactgatacaagngactcaccatggagtttggctgagcgtggtttacgtgtgctatttaaagtgtccagtgtcagtgcagctgtgagtcgggagcgtgtccgagcgggggtccngaactctcatgtgtcncggctcgtcgcttacacacgtttcacgttacgacctccggtattacgtacgttaccgtcggttaaccccggtaccgtagttccgtttacggaacccggggtaaacggggtccgtttaggggacggttaacgggtacggtttccggggtaccgttaacgtttaaccggaaaccctaaccgttcgaacgacgttacggacgtaactacgtttancgtacgtcgtaccggcggtacncgtaacggactacggttacaccgtactcaccgtaagacgttagtacgtaccgttacgacgaaacgttaacccgtggtaacgttcgttacgaccggttaaanaaaccttacgggaaaccctacgtttacccggtaaaaacggaccgtaacgtaaaccgggaccgttaccccgggttagtttaccaacggttacggtaacccgtaccgtaacgttaacccgttccgtacccggggttttaacttccggtttaaaccgttttccgtttaacggtaccggttaccggtttaaccccgg

SEQ ID NO: 60219 - DNA, 954 bp, Homo sapiens
  misc_feature: GYAE6OF02IQR3T.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggagtttgggatgagcgttgggttttccttgttgcttaagttttaaaaggtgtcagtgtcaggtgcagtctggtgggacggtccgggggaggtcgtttcggtccgacgggtcccggggggggttaccctacggtaaaccttccgtacgaacgttcggtacggacggtacgggtccttcgttgggtaactttaccacgtaacgtttccgaggtacgtaaccgttccgggtacttaagttaacgttaacggtttccggggtccccggaccgttaacggttccggttaacgggggaacccgggggtaaaacggggttcggttacgggggtaacgggtttcggggttaccggttttacggggtaaccggttttaaacggtttaaaaccggaaaaccccgttaaaaacccgttacggtaaaacccggtaaaacgggtaacccggtaccgttaaaaccgtttaaagttttacgtacggttacggttacgggtacccgggtttccgggtacggtaacgggtaaacggggttccgttaacccgggtttaccaaaacccggttaccgtttacccggtaaccgtaagggtaacggtaacgttaacgtaacctttaccgggaaaggtaaaccggtaaacccgtacgggttacgttaacgtcgtaacggtaacgtaaagtacgtaaaccgacgtaaccggtaaacgtaaaaccggacggtaaccggtaacggtccggttaagttacgttacggtcgacgtaccgtaacgtccttaaggttcccgttacgttacgttttaacgttttcgttttacgacggttcgttaaccgg

SEQ ID NO: 60220 - DNA, 735 bp, Homo sapiens
  misc_feature: GYAE6OF02I0PJL.26.57.F02.1.454.CMB.1.raw
  modified_base (649)..(649): a, c, t, g, unknown or other
  misc_feature (649)..(649): n is a, c, g, or t
  modified_base (681)..(681): a, c, t, g, unknown or other
  misc_feature (681)..(681): n is a, c, g, or t
tcagagactatactcacgaccggtgctcgatttagctcgatatagttgggtttggggctgggagaggagctccagccttgggattcccagctgtctccactcggtgatcggcactgaataacaagagactcaccatggagtttgggctgagcttgggtttccttgttgcttaattttaaaaggtgtccagtgtcaggtgcagctggtaggaggtccgggggagtcgttggtccagggcccggggggtccctagaaactctcagtgtgcgaggctcgtggattcaactattcaagtgacgtaccggtacttaagtacgtaaccgtggggtacccctaccgtaggttccggttccgggaacccgggggtaaaaggtccggtagggtaacgggtggtcccggtttagggaccgtttaagttaaacggaaaaccccgttaaaccttaggaaaccgtaaaggttaaccgacgtaaacgttaaagtttactacggtacgttcggtacggttacgggtagaccgtaagggtccgtaaggttcccaacgtacgtccgtaacgtaacgaggtactacgtacgtacgaacggttaaacgaccgtacgggtaccgtaatcgacgaataaagacgtaacaacgtccgtaaagaaacccggngaaccgtccggtacgttagtacgttagcgtanaccgaactacctagtcccgtaattaacttcgtttattacggtcgtccgttaacg

SEQ ID NO: 60221 - DNA, 828 bp, Homo sapiens
  misc_feature: GYAE6OF02GYMNN.26.57.F02.1.454.CMB.1.raw
tcagagactatactcacgaccggtgctcgatttagctcgatatagttgggtttggggctgggagaggagctccagccttgggattcccagctgtctccactcggtgatcggcactgaatacaagagactcaccatggtagtttgggctggagtcgttggggttttaccttgttgtacttaagtttttaaaaggtgttccaggtcgtacagggtgacgagtccgtggggtgggacgggtccggggggacggtcgttcgggtacccgacggggtacccgggggggttccctaggtaaacctccttacgagtcggtcgcgaggtccgtcgtagggtacttacacctattcgagttcgaaccgttcgattaatacgttacgttcgggtcccgtctacggtcgtcggggaaccggggaaaggtcgtaggggacggtcggtccgttaggtaccggtaattaccgaaaacctaaaccgttgaacccgtaaacgggtacctacggtaaactttaagttaacgtcggttaccgttacgggacccggggttttaccggagggtaacccgaagggttaccgtaacggggttaccctaccggtaaccttacccggtaccgtaaacgtacggtacgtaggttaacgtacggaaggtaaacgaaccggtaccggtagtactgtactaactaacgtaacgacgtacgaaccgtaacgaaacggtacggaacggtaaccgcgttaacgttacggttactagggacctaaccgtacttaacgaccgtttagttacccgttagtttaacccgtttaggttttcgtaccggttaccgttaaccccgg

SEQ ID NO: 60222 - DNA, 859 bp, Homo sapiens
  misc_feature: GYAE6OF02G1PPV.26.57.F02.1.454.CMB.1.raw
  modified_base (725)..(725): a, c, t, g, unknown or other
  misc_feature (725)..(725): n is a, c, g, or t
tcagagactatactcacgaccggtgctcgatttagctcgatatagttgggtttggggctgggagaggagctccagccttgggacttcccagctgtctccactcggtgatcggcactgaatacaagagactcaccatggagtttggctgagcgttgggttttccttgttgtcttaattttaaaaggtgtcctagtgtcaggtgcagcgtggtggacggtccgggggaggtcgttcgggtcccgacggggtccccggggggggttacccctacggtaaaaccgttccgttaccgtacgttacggttcggaccggtagggtaccgttccgtacgggttaacgtttaccctacgtaacgtttacccgtaggttcggtaaccggttacccggtaccgttaaacgttaacgttaacggttccggggttaccccgaccccgttaccggtaccggttacgggacccgggggtaaacggggtacggtaccgggtagggtacggtccggtttacgggtaccgttaacgtttaaccggaaaccctaacccgtacgtaacgtaacgtacggtacctaacgtaatttaacgtcggtactcggtaccgtcgggtcgtaccgaagggtccgtacggttacctacccacgttaccgtaccgagtaacggtacttacgtacgtactaggtaacggtaaaccggaccggtaccgtacgtagtacgacgtaacgtacggaaacncgggtaacctaacgaaaccggtaggaaccgacggtaccgtacgttacgttacgtacgtaccggtaccgaacgtaccgtaccgttaccgtcggtttacttaaccgttacgtttttaccgtaggttaccgtacccg

SEQ ID NO: 60223 - DNA, 728 bp, Homo sapiens
  misc_feature: GYAE6OF02JC9T1.26.57.F02.1.454.CMB.1.raw
  modified_base (427)..(427): a, c, t, g, unknown or other
  misc_feature (427)..(427): n is a, c, g, or t
tcagagactatactcacgaccggtgctcgatttagctcgatatagttgggtttggggcctgggagaggagctccagccttgggattcccgagctgtctccactcggtgatcggcactgaatacaagagactcaccatggagtttgggctgagctgggtttccttgttgctatttaaaaggtgtcccagtgtcagtgcagctggtgaggtccggggagcttggtccaggccggggggtccctagaaactctcactgtgacaggtctcgtggattcaacgcttacgtagtggacctcggtctaagttacgtaccgttcgggtcccgcctagtcgtagaccgggggaaaggcgtacgggagtaggcgttcggacgttacgttacgaaccgtaaaccgtgaaccgtaagtaccgacgtactaagtttaacngtactgcgtcggtgacgaacggtcgaggtttccaccgtagtcccgaccgtagaagagtacggtaacgtcgtaaccgaaggttaccgaacgggtcgtaaaccgttcgtacggtaaacgaaattaaccggaaccgtaaccggtaccgttaaacggaaaacccccgggtaggaaacccggtaacccggtccggttaaaccggttaccgttaacggttccggaccgtaacccgaggtaacctaaccggtacccgttaccgttacgttacggttaacctttttcggacggttcccgttaaccccgg

SEQ ID NO: 60224 - DNA, 745 bp, Homo sapiens
  misc_feature: GYAE6OF02GXF63.26.57.F02.1.454.CMB.1.raw
tcagagactatactcacgaccggtgctcgatttagctcgatatagttggggtttgggggctgggagaggagctccagccttgggattcccagctgtctccactcggtgatcggcactgaatacaagagactcaccatggagtttggctgagcgttgggttttcctggttgcttaattttaaaggtgtccagtgtcaggtgcgagcgtggtgggtacggtccgggggaggtcgtggtccgagggtcccgggggggtcctagtaaacgtcctacgcgtgtcgacgacggtctacggtaggtacttcaacttagttacgtacgtaggtaaccgtcggtactagtacgtacggttccgggacccgtaccgtacggttccggtacgggaccgggggaaagggtcgtagggtacgggtggtacggttccgggtaaccgttaagttaaccggtaaaccctaaccggttacgaaaccgtaacggtaccggtaccgtaagtttaagttacggtacgtacgttcgggacggttacgggtacgacggaaacgggtcctaacggttacccaacctagtacctaccgaagtaccgtaagtgtaacggtacgaacgtacgaacgtacgcgttatccgaagtaatacggactacgaacgacgtaaaccggagaacgaccggtacgtacgttagtacgtgacgtcggactacgacgtacgtcgtacgttacgttaccttaggtttcgtaggtaccgtacgg

SEQ ID NO: 60225 - DNA, 814 bp, Homo sapiens
  misc_feature: GYAE6OF02F0EBS.26.57.F02.1.454.CMB.1.raw
  modified_base (459)..(459): a, c, t, g, unknown or other
  misc_feature (459)..(459): n is a, c, g, or t
tcagagactatactcacgaccggtgctcgatttagctcgatatagttgggtttggggctgggaggaggagctccagccttgggattcccagctgtctccactcggtgatcggcactgaatacaagagactcaccatggagttgggctgagcttgggttttccttgttgcttattttaaaggtgtccagtgtcaggtgcagcgtggtggaggtccgggggaggtcgttggtccgacgggtcccggggggttccctagtaaaccgtctcgatgtgcgtaggtcgtcgtggtatcacgtattcgagtcgacctcggacttatagttaccgtcggtcccgccgtacgtcgtcgggtaccggggaaagggcgtagggaggttcgggtcgttagggtacccgtaagttaaccggaaaccctaaaccgtagaaccgtaaagtaccgacgtaacgtaaattttacgngtccgttacggccggttcggtacggtacggaaacgggtccgtaacggttaccgtaacccgtaacgttcccgttaccgaacggtacggtaacgttacggtaacgtttaccggtaaacggttaaacgggaaaccggtaaccgggttaaccgttacgttaccggttaaacgtaaccgtaaaacgttaccggaaactaacccgggtaaccgtaaaccgggtaaaacccgggtaaccgggaaacccgtaccgggtaccggttaacggttacttaccggtacggtacggtaccgaacgtaccgtacgttacccggtacgtttaaccgttacggtttacttttacgtacgggttactaccgg

SEQ ID NO: 60226 - DNA, 678 bp, Homo sapiens
  misc_feature: GYAE6OF02JKNLF.26.57.F02.1.454.CMB.1.raw
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
  modified_base (526)..(526): a, c, t, g, unknown or other
  misc_feature (526)..(526): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggtagtttgggctgagtcgtggttttccttgttgacttaatttaaaggtntccagtgtcaggtgcagctggtggngtccgggggagcgttggtccgaggccgggggtcctagaactcctgatgtgctaggctactggtattcacngttcagcgtactggtacctaanccgttacgtcgggttacccgcctatccggtacggaccggggtaaaggtccgagggtacggtgggtacgttcgggtaccgttaacgttaacccgaaaccttaaacgngaacgtaacgtcgacgtaacgttaatttcgagttgtacgtggtaccggtagaccggtaaggtccgtacgttacccgtaccagtcccctcgaagtacgatagtcttaacgacggttaanccgtagtaccgntaacncgtacgaanactacgacgtaacgtaacgacgaagaccggtccgtaggtacttcgtagtacggtcgagtaacggacgttccgttacccggttattaccgtttacgtttaacccggttggtacccgtcgttaccggg

SEQ ID NO: 60227 - DNA, 872 bp, Homo sapiens
  misc_feature: GYAE6OF02G6CPD.26.57.F02.1.454.CMB.1.raw
  modified_base (371)..(371): a, c, t, g, unknown or other
  misc_feature (371)..(371): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcgttgggttttccttgttgcttaattttaaaaggtgtccagtgtcaggtgcagcgtggtggaggtccgggggaggcgttgggtccgacgggcccggggggggttccctaggaaacctccgtacgtagtcggtggccgagggtccttcgtgggtatttaccgaactatttaccgaggtcgaactccgggaccttaattacgttaaccgtcggggttaccccnccgtaacggtttccgtacggggacccggggggaaaacggggtccgttagggggaacggttgggtccggttttacggggacccgtttaaggttaacggaaaaccccgtaaaacccgtttacggaaaccgtaaacggtaacccgaccggaaaactttaaagttttacgccggtacgtttcggaccgggttcgggtacgaccgtaaacgggtccggtacgggtttaccacccgtaactcccgtaaccgtaaggaacgttagtacggtaacgttacgaacggtaacgaaaccggtacgggtaacgttaaccgtttaccgtacgaacgttaaacgtaaccggtaaacgtaccgtaaccgtaaacgggaaaacccggtacgggaaaccgtacccgggtacgttacgttaccgttacggtcgtaccggaaccgtaacgtaccgtaaccgttaccggttacgtttaacgtttacggttttactttttacgaggtttacccggtacccgg

SEQ ID NO: 60228 - DNA, 829 bp, Homo sapiens
  misc_feature: GYAE6OF02IJDPF.26.57.F02.1.454.CMB.1.raw
  modified_base (276)..(276): a, c, t, g, unknown or other
  misc_feature (276)..(276): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttggctgagcgtgggttttccttgtgctattttaaaaggtgtccagtgtcaggtgcagcgtggtgggaggtccgggggaggtcgttcggtaccgaggggcccggggggtccctgtaaacgtcgtcgagtgtcgcgnggtctcgtaggtagttacacgtattcaaggtcgactccggacttagtacgtacgttccgggtcccgtccgtaacggttccgttacgggaaccgggtaaacgggtcgttcgggacggttcgggtaccggtttcgggtacccggttaagtttaaccggaaaaccccgtaaaccgtacggaaaccgtaaacggttaccgaacggttaaccgtaaagtttcgtacgtcgtcgtcggttcgggtacgaccgtaaggccgtaacggtcctaaccgtaccgtttaccaccggtagtaaacgtacgttacgtaacgttacgaaacgggttaaccgaaaacggtacccggtgtttaacgtaacgtcgtaaagttaaaccggacgaaacgtaccggaaccgttaaaccgggaaaccggaaccggtaccggtaaccgggtttaaccgtacggtttacttaccgggtagtaaccccggtaactaacccgggtactaacccggttcccgtttacggtaaccgttttacgttttaacccggttttcgaacggtttcccccgtaacgg

SEQ ID NO: 60229 - DNA, 813 bp, Homo sapiens
  misc_feature: GYAE6OF02I7IQW.26.57.F02.1.454.CMB.1.raw
  modified_base (221)..(221): a, c, t, g, unknown or other
  misc_feature (221)..(221): n is a, c, g, or t
tcagagactatactcacgaccggtgctcgatttagctcgatatagttggggtttggggctgggagaggagctccagccttgggattcccagctgtctccactcggtgatcggcactgaatacaagagactcgaccatggagtttgggctgagtcttgggttttccttggttcgactttaagtttttaaaaggtcggtacctaggttcgtacgtagggttcnctacgcgttgggtaggagggttccgggggaggtcgttcggtccgaggggcccggggggttcctaggtaaacctcgtcgagtcgtcgcgacggtctcgtggtactcgtacgtaattcgagttacggtccgtcggtacttaagtaacgttaccgttcgggtaccctcgaacgttccggtacgggaacccggggaaggttcggtcgggtaacggttcggtcggttacggtccggttaaataaaccggaaaccctaacgtacgtaacgaaccggtacggaccttaaacctaagtttagtccggtatcgttccgggtacggtagaacggaacggtcgtacggtactaaccgtactaccgacgacgtaagtacgtgtaacgtagagaacgtacgtacgtacggtacgttacgaacggtaactaacgaacgtaaccgtaacgtaacccgttaaacggaaaccggaccggtaacggtaacccggtaagttaccgttacgttaacgggtaccgtaccggtaacgtacgtaaccggttacgttaccgttaacgtttaaccggtttacgtttacgtttttaacggcgtttaccggttaaccgg

SEQ ID NO: 60230 - DNA, 796 bp, Homo sapiens
  misc_feature: GYAE6OF02JOZXQ.26.57.F02.1.454.CMB.1.raw
  modified_base (285)..(285): a, c, t, g, unknown or other
  misc_feature (285)..(285): n is a, c, g, or t
  modified_base (494)..(494): a, c, t, g, unknown or other
  misc_feature (494)..(494): n is a, c, g, or t
  modified_base (646)..(646): a, c, t, g, unknown or other
  misc_feature (646)..(646): n is a, c, g, or t
  modified_base (675)..(675): a, c, t, g, unknown or other
  misc_feature (675)..(675): n is a, c, g, or t
tcagagactatactcacgaccggtgctcgatttagctcgatatagttgggtttgggctgggagaggagctccagccttgggattcccgagctgtcgtccacgtcggtgatcggcactgaatacaagagactcaccgatcggagtttgggctgagcttgggtttcttgttgcttaatttaaaaggtgtccgtagtaggtctacggtgcgagcgtaggtggagtccggggagtcgttggccgacggccggggggtcctacgaaccgtcgtacgtagtcggtagacgnggtcgtcgtcggtaacgttcgtacagttcgagttacgacgtcggtactacttagtaccgttacggtcccgcgtacggttcccgtaggccggggttaaaagggccgttaagggtcgggtttaccgggcgtttccgggtaccgttaaacgttacggtaaaacccctaaacggtcgaaacgtaacgtacgaaccgttaacgtaaagtttcgngtacgtacggtcggttaccggtacgacgtaaagggacgtacgtacccgtacgtaacgttcgaacgtacggaaacgtcgtacgtaacgttacgaaggtaaacgtacgtaacggtcgttaactacgtaggaacctaaggtaacaaccggttacnccgtaaagggaacccgaagggtaaacccncggggttaccgtaagttccgtaagtcgggttaaccacggaaccggttcgtaaccgtttcccggtaacgttttaaccggttaccgttaaacggtttttctaacccgggttcgttaaacccgg

SEQ ID NO: 60231 - DNA, 624 bp, Homo sapiens
  misc_feature: GYAE6OF02FT38W.26.57.F02.1.454.CMB.1.raw
  modified_base (191)..(191): a, c, t, g, unknown or other
  misc_feature (191)..(191): n is a, c, g, or t
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcggtggtttcgtcgtagctattaaagtgtcagtgtcaggtncagctggtgacggtccgggagtctggccaggtccggggtccagaactctacacgtgtgcgagtcctcgtggtacttcnctacttaccaggttcaacgttccgattactaagtacgtcggttaccacnccggttncggaccggtaaggngtcggacgtgtcgttcgcgtaattacgaacctagntacagaccgnatagttgntacgtgactcggtanacgtgtcgtagtccactactaccgtgagtacattagacctagacgaaacgtaccggaacgtacgtacgttactaacgtaactaaccggatacgtaaccaaccgggtaaccaaaccgggtacgtaaccggcgtacgttactactcgtacgtaccgtatccgtaaccgttgtaaccggttcgttaactttaccgtttagttccgacggttaccgtacgg

SEQ ID NO: 60232 - DNA, 727 bp, Homo sapiens
  misc_feature: GYAE6OF02F7CWH.26.57.F02.1.454.CMB.1.raw
  modified_base (702)..(702): a, c, t, g, unknown or other
  misc_feature (702)..(702): n is a, c, g, or t
tcagagactatactcacgaccggtgctcgatttagctcgatatagttgggtttggggcgtgggagaggagctccagccttgggattcccagctgtctccactcgtgatcgacactgaatacaagagactcaccatggagttggctgagctgggtttccttgttgcttatttaaaggtcgtcagtgtcgaggtgcagcgtggtcggaggtccgggggaggcgttcggccgtacgggccggggggtccctacggtaaacgtctacgtatcggtgacgtacggctacgttcgtattaccgactattcgaagttcgacgtcgggacttatagtaccgtcgggtcccgtacgcgtccgtggacccggggtaaagggtctaggggtacgtgggtccgttacgggtccggttaattaaacggaaaccctaaaccggtacgaaacgtaaaccggtaccggacttaaaaccgtagtttaatcggtacgttggacccggttggtacgaccgtaggactacgggttacaacctatccctacgagtggaactgtaactgaagaaacgacgtacggtattacgacgtacgacaaacggaacgtaactaacggaccgtaaaaccgaaccgggtaacgaacggtaaccgtacggttatacgtacggtgtacacctacgtaaaccgttgttacccgtagtttaacccggttagttttntttaccggtaacggttccgtaacgg

SEQ ID NO: 60233 - DNA, 964 bp, Homo sapiens
  misc_feature: GYAE6OF02HQTCV.26.57.F02.1.454.CMB.1.raw
tcagagactatactcacgaccggtgctcgatttagctcgatatagttggggtttggggctgggagaggagctccagccttgggattcccagctgtctccactcggtgatcggcactgaatacaagagactcaccatggagtttgggctgagcgttgggttttccttgttgacttaatttaaaggtgtaccagtgttcaggtgacagtcgtgggtagggacggtccggggggaggtcgttcgggtccgacggggccccggggggggttccctaggtaaacccgttctaccgtaagttcggttcggaccgtaccgggtcccgttaggttacgttaccgtacctaacgtttaccgtaggttaccggaccgttaccgggtacgttaaccgttacgttaacggtcccggggttacccggttaccccgacggttaccggtccggggtaaacccggggggtaaccggggtaccggtacggggtaacgggttcgggttaccgggtttaccggggtaccgggttaaaccggtttaacggttaaaaccccggtaaacccgttaacggtaaaccggtaaaccgggtaccgggtaaacccggttaacgttaaacttttaaacgttcggtaccggtacggttacccgggttacggtacgggtacggtaacgggaccggttaccggtttacctacccgtaaccgtaccgttaacccggagtaaacggtacgtaaagttcctaacgggttaagaaacccgggtaacgtaaccgggtccgtttaactagggtacaacgttaaagtaacgtaacccggacgtaaacccgggtaaaccggaacccggtaaaccgtacggtaacccgggtacgtttaccgtagtttaccgtccgttaacgccgtaacgtccgtaaccggtccgtttaaccgttacgttttaccgtttaccggttttaacgttccggtacggttacccgtaggg

SEQ ID NO: 60234 - DNA, 861 bp, Homo sapiens
  misc_feature: GYAE6OF02HVGBY.26.57.F02.1.454.CMB.1.raw
tcagagactatactcacgaccggtgctcgatttagctcgatatagttgggtttggggctgggagaggagctccagccttgggattcccagctgtctcccactcggtgatcggcactgaatacaagagactcaccatggtagtttgggctgagcgttggttttccttgttgacttaagttttaaaaggtctcctagtgtcaggtgcaggtctggggtaggacgggtaccggggggaggtcgtttacgggtccgacggggtcccgggggggtccctaggtaaaccttctcagttgacgcgacggtctcgtggtacttcactacgttacgtaggtcgtaactcggacttaacttaacgtaccgtcgggtaccccgaccgtaggttccgacggggaccggggtaaagggtccgtaggggtacgtcgggtcgttacgggtaaccgttaacgtaaaccggtaaaaccctaaaacgttcggaaaccgttaaaggtaaccggtaacccgttaaattaaaacggttttcacgggtacctacgggggttcccgttaaccggggtacgtaaccgggaacgggttaaccggttaaccggtttaccccgtaaaccgttacgttaaccccggttaccggaacgttacgttaacgtacggttaaccgttaaccgaaacggtaaacgaaccggtaaccggtacgttacgtacgtacgtaaacgtaacgaaccgtacgtacctaacggtaaaccgaaacgaacggtaccgtaccgtaccggtagttaccttagtacggtcgtaaccgacgtaacgtacccgttaaccgttacgtttacgttttaaccgtttattttacggtacgttcccgttaaccgg

SEQ ID NO: 60235 - DNA, 735 bp, Homo sapiens
  misc_feature: GYAE6OF02FW5L5.26.57.F02.1.454.CMB.1.raw
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
tcagagactatactcacgaccggtgctcgatttagctcgatatagttgggtttgggctgggagaggagctccagccttgggattcccagctgtctccactcggtgatcggcactgaatacaagagactcaccatggagtttgggctgagcgtgggttttccttgttgctagttttaaaaggtgtccgagtgtcaggtgcagctggtggaggtccgggggagcgttggtccaggcccggggggtccctggaaactctcgatgtgcgagctctggattcanttcagtgactcggctatactacgtcgggtcccncgtagtcgtacggtaccgggaacgggtcgtaggaggtcggtcgtttcgggacccgttaagttaaccgaaaacccgtaaaccgtacggaaacctaaacgggttaccgaccggtaaactaacgttttaacgtcggtaacgtcggtaccggttcgggtacggtaccgtaacgggaccgtacgggtttaccaacccgtacgtacccgtaccgaaggtacgtaacgtacggttaactaccgtaaggtaacgaaccgtacggtacgtaacgtcgtacggactaaagtacgactacggaccgtacggaaaaccgtcgaacgtaccgtacgttacgttacgttacgtcgtaccgaccgtaagaaccgttacgttacccggttacgttaacggtttaccgtttacgtttttaccgacggtttccgtaacccg

SEQ ID NO: 60236 - DNA, 815 bp, Homo sapiens
  misc_feature: GYAE6OF02IGZ67.26.57.F02.1.454.CMB.1.raw
  modified_base (127)..(127): a, c, t, g, unknown or other
  misc_feature (127)..(127): n is a, c, g, or t
  modified_base (142)..(142): a, c, t, g, unknown or other
  misc_feature (142)..(142): n is a, c, g, or t
  modified_base (762)..(762): a, c, t, g, unknown or other
  misc_feature (762)..(762): n is a, c, g, or t
tcagagactatactcacgaccggtgctcgatttagctcgatatagttgggtttggggctgggagaggagctccagccttgggattcccagctgtctccactcggtgagtcggcaactgaatacaagngtactcaccagtggngttggctgagcgttgggttttcctgttcgtacttaagttttaaaaggtcgtaccgagttggtcgtagggtgccgtaggcgttgggtcgggagggttccggggggagtccggtttacggaccggtcgggggtccggggggtaccctaggtaaacgttcgtacgagttcggtcggacgtcgggttcctcggtttggaccttccaacgttacgttcgaacggttcgtaccgttacggtacttaagtttaaccgtacggttaccgggtccgtaccgtacgtttacggacggaccggggaattccgggtagggtaggtaccgttcggtacggttaccgttaaacgttaccgaaaacccgtaacgttaacgaacggttaaccggtacggactaaaccggtttaagtcggtacggtaactcgggtacgtacgggtagaccggtaggtaccggtacgttaccagttaaccgtcgaaccgtagtaacgtacgttacggtacgttaaccggacggtaaaccgtacgtacggtacgtttacgacgttaacggaacttaacggaacgtaccgaacgtaaccgttaaacgaacgggtaccgacgtacccgtagttacgttacttacgcgtacncgtacaccgttactcggtattaccgggttacttagtttacacggtacttacgg

SEQ ID NO: 60237 - DNA, 716 bp, Homo sapiens
  misc_feature: GYAE6OF02JL71N.26.57.F02.1.454.CMB.1.raw
  modified_base (281)..(281): a, c, t, g, unknown or other
  misc_feature (281)..(281): n is a, c, g, or t
tcagagactatactcacgaccggtgctcgatttagctcgatatagttgggtttggggctgggagaggagctccagccttgggattcccagctgtctccactcggtgatcggcactgaatacaagagactcaccatggagtttgggctgagcttgggttttcctgttgacttatttaaaggtgtccagtgtcaggtgcagctggtggaggtccggggagcttggccgaggccggggggtccctagaaactcgtcattgtgcgtaggctcgtggtacttcatnttccgagtcggacgttcggtacttaacgtagtaccgtcggggtaccgcctagtccgtcgaccggggaaggtcgtgggtacgtaggtccgttacggaccgttataaccggaaaccgtaaccgtcggaaccgtaacggtacgacgtaactaagtttacgtagtcgttcggtacggttaccgggtcgtacggtaacggtccgttaggttaccaccgtacgttacctaccgaggaagtagttactacgttacgaacggttacggaacgtaccggtagttactcgtacgtaaactaagtacgacgtaacggtacgtaacgggaaccgaacggaccggttaccggaccggtttaggtacttacggtacgtccggaaccgtagtacccgtacgtacgttcgttaagtttcccttaaggttttcccagggtttcccgtaaccg

SEQ ID NO: 60238 - DNA, 861 bp, Homo sapiens
  misc_feature: GYAE6OF02GTZ5Y.26.57.F02.1.454.CMB.1.raw
tcagagactatactcacgaccggtgctcgatttagctcgatatagttgggtttggggctgggagaggagctccagcccttgggattcccagctgtctccactcggtgatcggcactgaatacaagagactcacccatggagtttgggctgagctgggttttcctgttgctattttaaaaggtcgtccagtgtcgaggtgcagctgggtggacggtccgggggagtcgttggccgacgggcccgggggggtccctagtaaaccttctcacgtgttggccgaggtcctcgtggtattccgactacgttcacgttggacctcggtacttaacttacgttaccggtcgggtcccgtccgtaacgtccgttaccgggacccggggaaagggtcgttaggggtacggttcggggtaccgtttcgggaaccgtttaacgtttaaacccggaaacccgtaaaacccgtcggtaaaccgtaaacgggtaccccgaacggtaaaccttaaacgtttagtcggtaccgtttaggtcccggggttacggttacggaccgaaagggtacccggttaccgggtttaaccgaccctacgttcccgtaaccgtaggtaacggtacgttagtaaccggtttccgaacggtaaaccggtaacggtacgggttaaccgtagtacccgtaggtaaccgtaaataccggaaccgtaacggttaacccgaaacggtaaaaccggccggtaaacggttaccgttaccgttacgtacgtttacggtaccggtactaccggaaccgtaacccgtaaccgtttcccggttaacgttaaaccgttttaccgtttaccgttttaaggcccgggtttacccggtaacccg

SEQ ID NO: 60239 - DNA, 708 bp, Homo sapiens
  misc_feature: GYAE6OF02JFW20.26.57.F02.1.454.CMB.1.raw
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagagactatactcacgaccggtgctcgatttagctcgatatagttgggtttggggctgggagaggagctccagccttgggattcccagctgtctccactcggtgatcggcactgaatacaagagacctcaccatggaggtttgggctgagcgttcgggttttcctttgttgcttaagttttaaaaggtgtccagttgtcaggtgcgagcgtggtggacggtccgggggaggcgttgtccgacggtccgggggtcctgaacncgtcagtgtgcngctcnggtactcncattnacgtagcgtccggactattacgccgttcggtcccgcgtacgtcggaccgggaacggggtaacggtcgtgggtagtgggttccgttacggacgtttacgtaaccgaaacccgtaaaccgtacgaactaacggtacgaccggtaacttaagttacgtgtacgtcgtcgggtcgtacggacgtacggacgtacgttaccgccctacgtccgtacctaagcgttaacttgtaagtaccgtaaggaacgaacgtacgggtaccttagtctaacgtacgtaaagtaacgacgttaacgacccgttaacgggaaaccgacggtaaccgaccggtccgttataccgttcgacgtcgaacgtccgtactaccggttcgtaccgtttagtttaccgttttcgttttagtacggttaccttacggg

SEQ ID NO: 60240 - DNA, 747 bp, Homo sapiens
  misc_feature: GYAE6OF02HRJYJ.26.57.F02.1.454.CMB.1.raw
  modified_base (130)..(130): a, c, t, g, unknown or other
  misc_feature (130)..(130): n is a, c, g, or t
  modified_base (432)..(432): a, c, t, g, unknown or other
  misc_feature (432)..(432): n is a, c, g, or t
  modified_base (495)..(495): a, c, t, g, unknown or other
  misc_feature (495)..(495): n is a, c, g, or t
tcagagactatactcacgaccggtgctcgatttagctcgatatagttgggtttggggctgggagaggagctccagccttgggattcccagctgtctccactcggtgatcggcactgaatacaagagactnaccatggagtttgggctgagctggttttcctgttgcttattttaaaaggtgtccagtgtcgaggtgcagcgtggtggaggtccgggggagcgttggccgagggcccggggggtccctagaaactcgtacgattgtgcgaggctacgtaggtacttcacattcgagtacgactcggtatatagtacgtcggtaccgactagtcgtaggacccggtaaggccgtaggtaggtacgtcgttcggtaccggttagttaacgaaacctaacgtgaaacgtaacggtacgacgtaacgttaagtttancggtacgttcgtccgggtacggtaccgaacggtaaggtccgtaaacgggttaccaacccggtntaccgtaaccgagtaacgttagtacgttataacggagaaccggaaacctcggtagtaactcgaaagtaacaaacgttacgaaactacccggaaccgttaaaagggaaacccgtcgggaaaaccgtacccgggacgttaacgttacgttaacgtaccggacgttaacccgaacgtaccggttaaccgttccgggtttaaccttaagtttaacccggttttttagtttacccgtagggtacccgttaaccccgg

SEQ ID NO: 60241 - DNA, 730 bp, Homo sapiens
  misc_feature: GYAE6OF02HGJMU.26.57.F02.1.454.CMB.1.raw
  modified_base (412)..(412): a, c, t, g, unknown or other
  misc_feature (412)..(412): n is a, c, g, or t
  modified_base (504)..(504): a, c, t, g, unknown or other
  misc_feature (504)..(504): n is a, c, g, or t
  modified_base (539)..(539): a, c, t, g, unknown or other
  misc_feature (539)..(539): n is a, c, g, or t
  modified_base (580)..(580): a, c, t, g, unknown or other
  misc_feature (580)..(580): n is a, c, g, or t
tcagagactatactcacgaccggtgctcgatttagctcgatatagttgggtttggggctgggagaggagctccagccttgggattcccagctgtctccactcggtgatcggcactgaatacaagagactacaccatggagtttgggctggagcttcggggttttccttgttgacttaattttaaaagggtgtccgagtgtcgacggtgcagctgggtggaggtccggggggaggcttcgggtaccgagggtccccggggggggtaccctaggtaaacctcgtcagttgagcgtacggtcttacgtggtactttaccactattacaggttacgtacgtccggtcttaagtacttaacggtccgggtacccgccgtaccggttcggtacgggacccggggaagggtctaggggnggtcggtcgttcggtaccggttacgtaaacgaaacccaaccgtagtaaccaaggtacgtacgtaataatttacgtcgacgtggtccgtaggngacgtaggctacggttccaccacgtcctacaggtnaatcgttaactacgaacggtacggaaccgtacggtacttanaccgtagtagaaataccaagtaccgaacggtaacgaaacggacggacggtacggtacgttaccgttatacgtggcctaccgagtactaccgttaccgtaacgtttaacgttaccgtttttacgtttacggttaccggtacggttaacccg

SEQ ID NO: 60242 - DNA, 738 bp, Homo sapiens
  misc_feature: GYAE6OF02FV6BL.26.57.F02.1.454.CMB.1.raw
  modified_base (197)..(197): a, c, t, g, unknown or other
  misc_feature (197)..(197): n is a, c, g, or t
tcagagactatactcacgaccggtgctcgatttagctcgatatagttgggtttggggctgggagaggagctccagcccttgggattcccagctgtctccactcggtgatcggcactgaatacaagagactcaccatggagtttgggctgagctgggttttccttgttgctattttaaaaggtgtccagtgtcaggtncagctggtggagtccgggggagtcgtggtcgacgggccggggtccagtaactcactatgtgacgaggtctcgtaggtacttccgactattacgagtacgtaccgtcggtacttaatacgttaccggtcggggtaccccgacgtacggtccgttcgggtaaccgggggaagggtccgttagggtaggttcgggtcggtttacgggtaccgtttaagttaaaccgaaaacccctaaaccggttagaaacgtaacggtaccggaccgaaactttaattttagcgtacgtcggtacggtacgggtcgacgaaggtccgtacgttaccaaccgtactcctaccgagacgtagtacgtaacttacgaaggaacgtaaaccggcgtacgttactacgtacgaaactaaagacgtaacgaccgtaccgtaacggaaaccgacggaaccgtaaccggtcgttaacgttagttacgtggtaccgaacgtaacgaacgtaccgtccgttacgttactttaaccgtttacttttacgtacggttccgtaaccg

SEQ ID NO: 60243 - DNA, 702 bp, Homo sapiens
  misc_feature: GYAE6OF02JYO8G.26.57.F02.1.454.CMB.1.raw
  modified_base (315)..(315): a, c, t, g, unknown or other
  misc_feature (315)..(315): n is a, c, g, or t
  modified_base (460)..(460): a, c, t, g, unknown or other
  misc_feature (460)..(460): n is a, c, g, or t
tcagagactatactcacgaccggtgctcgatttagctcgatatagttggggtttggggcgtgggagaggagctccagccttgggattcccagctgtctccactcggtgatcggcactgaatacaagagactcaccatggtagtttgggctgagcgttgggttttccttgttgtacttaagttttaaaaggtgtccagtgtcaggtcgctagcgtggtgggacggtccgggggagtcgttcggtccgagggtcccggggggttccctaggtaaactcgtcgtacgtggtgcgaggtcttacgtggtactcaacgtnttcgagtcgcgtcgactatacgtacgtgggtcccgacgtacgttcgtacggtacggggaaacgtcgttgggacgtcggtcgtacggtaccgttataaccggaaacctaaccgaggtaaccgaacgtacgcgtaactaagtttacngcgtaagcggtcgtagaccgtaagtctaacggttccaactgtccgtaacgagtagtatagtactgaacgtaagaccgtacgggtctacgtcacgaactaaagtacgaaccgtgttaaccgaaaggaaccgttaaggacccggaagttcgttacgttacgtcgttaaggcccgttaacaacgtcggttaaccctaccggttattaccggttaacgtttcttttaaccgtcgggtacgttaccg

SEQ ID NO: 60244 - DNA, 770 bp, Homo sapiens
  misc_feature: GYAE6OF02FFL9C.26.57.F02.1.454.CMB.1.raw
tcagagactatactcacgaccggtgctcgatttagctcgatatagttgggtttggggctgggagaggagctccagccttggggattcccagctgtctccactcggtgatcggcactgaatacaagagactcaccatggagtttgggctgagcgtggttttccttgttgtctattttaaaaggtgtccagtgtcaggtgcagctggtggaggtccgggggaggtcgttggtccgtagggcccggggggtccctagaaacctctcagttgtgcgaggctgtggtatcacagttacagtgacgtccggtacttaagtacgttaccgtcggggtcccgaccgtagtccgtacggaacccggggtaaaggggcgtggggtacggtcgggttcgtttcgggtaacccggttagtttaaaccgaaacccgtaaaccggtcgaaaccgtaaggtacccgtaacggtaaccgttaaattttacgacggtcgttacgggtccggtacggtacgaccgaaggtcggttaacgttacccaccgtattcccgtaacgtaggacgtacgtacgtacgttacgaaggtaacgaaccggacggttaccgttaagtcctaacggtaacaaacggtacgtaaaccgtacggaacccgttaaaggaaacccggaacgtaaccggaccgggtcccgttagttacgttacgtacggtccgacaaccggtactacggttcccgttaacgttacgtttaacgtttacgttttaccgtacggttacccgtaccg

SEQ ID NO: 60245 - DNA, 767 bp, Homo sapiens
  misc_feature: GYAE6OF02I9S2P.26.57.F02.1.454.CMB.1.raw
  modified_base (216)..(216): a, c, t, g, unknown or other
  misc_feature (216)..(216): n is a, c, g, or t
  modified_base (354)..(354): a, c, t, g, unknown or other
  misc_feature (354)..(354): n is a, c, g, or t
  modified_base (644)..(644): a, c, t, g, unknown or other
  misc_feature (644)..(644): n is a, c, g, or t
tcagagactatactcacgaccggtgctcgatttagctcgatataggttgggtttggggctgggagaggagctccgagccttgggattcccagcctgtcctccactcggtgatccggcactagaatacaagagactcacctagtggtagtttgggctgagcgtgggttttctgttgcttagttttaaaggtgtaccagtgtctaggtgcagcgtggngggaggtccgggggatcggttggtccggaggggtcccggggggtacctacggtaaaccttcgtccgaagttcggtcgacggtacggccgttacgtaggtacttacactcgttaccgagttcgacgtcgtactaacgtntaccggtcggtccaccgacggttcgacgggaaccgggagtcgtaggcggttcggcggtacgtcgtaacgttaacgaacttaccgagtacgaaagtaccgagtaactagttactcggacgtcgtacggtcgaaggtaccgaacgttcgacggtacctaacggtccgtacgtacgacggtaagtattaccggtaagtacgtacggaaacggttaaaccggagtcgttaaccgtctaacgggttaaacgaaccggttaagtaacccgacaaccgggtaacgaacgggaacccncggtttaacggaccgttagtttaacgttacggcggttaccgaacccggaagttccccggttacgttacccgtaacgtttacgttttccgtttaacgggtttacggtaccttcccggggttaac

SEQ ID NO: 60246 - DNA, 512 bp, Homo sapiens
  misc_feature: GYAE6OF01EGWRF.43.87.H10.1.454.CMB.1.raw
  modified_base (506)..(506): a, c, t, g, unknown or other
  misc_feature (506)..(506): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccacctcccaaactcctatcctacaggaataacaaccggccctcagggatctcagagagattatctgcatccaggtcaggaaacacagcctccctgacccattactggactccagcctgagacgaggctgactattactgctcagcatgggacagcagcctcagtgccttgggtgttcgggcggagggaccaagctagaccgtccgtaggtcacgcccgaaggcctgccccctcggtccactctcgttccccacccttcctccnctaacc

SEQ ID NO: 60247 - DNA, 531 bp, Homo sapiens
  misc_feature: GYAE6OF01B609J.43.87.H10.1.454.CMB.1.raw
  modified_base (348)..(348): a, c, t, g, unknown or other
  misc_feature (348)..(348): n is a, c, g, or t
  modified_base (382)..(382): a, c, t, g, unknown or other
  misc_feature (382)..(382): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggacaaccaaggagcagcttggctgcagcagcaccaggccaccctcccaaactcctatcctacaggaactaacaaccggccctcagggatctcagagagattatctgcatcaggtcaaggaaacacagcctcctgaccattacnggactcagctgagacgaggctgactatactgctnagcatgggacagcagcctcagtgtcgttgggtgttcgggcggagggaccaaggcgtcgaccgtccgtaggtccacgcccgaacggccgtacgcccccgtcggtccaccgttccttccggttaccccaccccgtcctccgtaccttaccc

SEQ ID NO: 60248 - DNA, 573 bp, Homo sapiens
  misc_feature: GYAE6OF01CA54F.43.87.H10.1.454.CMB.1.raw
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggacaaccaaggagcagcttggctgcagcagcaccaggccaccctccaaactcctatcctacaggaactaaacaaccggccctcagggactctacagagagattatctgcatccaggtcaaggaacacacgcctcctacgacctattaccgtaggacctccaagtccctaggacggacgacggctacgtactacgttactgactcacgtcaagtggacagcacgcctacgagtcgcgttcgggtcggttcggacgggtacgggaaccgacgcgtcggaccgtccgtaggtacacgaccgaacggccgtaccgcccccgtcggtcctacctccgttccgttacccctaccctccctaccgaccttacccg

SEQ ID NO: 60249 - DNA, 546 bp, Homo sapiens
  misc_feature: GYAE6OF01DUFAG.43.87.H10.1.454.CMB.1.raw
  modified_base (349)..(349): a, c, t, g, unknown or other
  misc_feature (349)..(349): n is a, c, g, or t
  modified_base (508)..(508): a, c, t, g, unknown or other
  misc_feature (508)..(508): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccaggccaccctcccaaactcctatcctacaggaataacaaccggccctcagggatctcagagagattatctgcatccaggtacaggaaacacagcctccctagaccattacnggactccagcctgacggacgaggctaggactattactgcttcagcagtgggacaggcagcctcgagtgcgtttggggtcggttcgggaccgggacggggaccaaggccgttacggacccgtcgtacgggtcacggcccaaggcctcgcccctcggtccncgttccgtccgttccccacccttccctcgtcctacccg

SEQ ID NO: 60250 - DNA, 554 bp, Homo sapiens
  misc_feature: GYAE6OF01BC0C5.43.87.H10.1.454.CMB.1.raw
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccaggccaccctccaaactcctatcctaacaggaactaacaaccggccctacacgggatctcagagagattatctgcatccaggtcaaggaaacacacgcctacctgaccattactggacctccagccctaggacggacgaggctcgaactattactgctcacgcagtcgggacagacgagcctcgagtgacgttgggtgttcggcggagggaccgagcgtacgaccgtcgtacggtcgacgaccgaacggcctaccggcccccgtcggtacctaccgttccgtccgttaccccaccccttccctcctaccgtacccg

SEQ ID NO: 60251 - DNA, 614 bp, Homo sapiens
  misc_feature: GYAE6OF01BNT1Y.43.87.H10.1.454.CMB.1.raw
  modified_base (307)..(307): a, c, t, g, unknown or other
  misc_feature (307)..(307): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggacaaccaaggagcagcttggctgcagcagcaccgaggccaccctcccaaactcctatcctaacaggaaactaaccaaccggccctcgagggactctacagngagattatctgacatccaggtcaaggaaaccacacgccctaccctagaccctaattacgtcggactcccacgcctaggacggacgaggtcctagaccttatacgtgactcagcgaagtcgggactacgacgaccgctacaggtcgtacggttcgggtggttaccgggacgggacgggtaccgtaagtcgtacggaccgtccgtaacggccgaacggtacccgaacggtccgtacccggcccccgtcggtacccgtaccttccgtcccgtttaccccctacccccgttctaccccgtaccttaacccg

SEQ ID NO: 60252 - DNA, 587 bp, Homo sapiens
  misc_feature: GYAE6OF01E0J3X.43.87.H10.1.454.CMB.1.raw
  modified_base (307)..(307): a, c, t, g, unknown or other
  misc_feature (307)..(307): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccaggccaccctcccaaactcctatcctacaggaactaacaaccggcctcgagggatctcagagagattanctgcatccaggtcaaggaaacacacgcctcctagacctattacgtaggactccgagcctaggacggacgaggctagacttattactgctcagcagtacgggacacgcacgtcctacgaggtcgtcgttggggtcggttaccgggcgggtacgggaccgtaacggcgtacggaccgtccgtacggtaccgacggacccgaacgggcccgtccggtcccccgtcggtaccctacccgttcccgttccgttacccccaccccttcccgtcctaccgttacccg

SEQ ID NO: 60253 - DNA, 722 bp, Homo sapiens
  misc_feature: GYAE6OF01EV6K1.43.87.H10.1.454.CMB.1.raw
tcagtgtgagtagtcacgaccggtgctcgatttagcagtactgcgttgggtttgggagggtggccctgggctctgctcctcctgaccctcctcactcactctgcagtgtcagtggtccaggcagggctgactcagcccacccgtcggtgtccaagggcttgagacagaccgccacactcacctgcactgggaacagcaaacaagtgttacggacaaccgaaggagccagcttggctgcagcagcaccgacggcccaccctacccaactcctatcctacagaactaacaaccggccctcgagggactctacgagacgagtattatctacgcactccgacggtaaccgaacgggtaaaccacgtaaccggtcccctacccgtacgtaaccctaacgttaccgtaggtaccctacccgtacgccgttaggacgggaccgacggaccgtaggtaacttaacgttacgtcgcttacgtacgacgtagtaccgggaacgacggtacgacgtacccgtacggtaacgttcggtcggtttacggggttcgggttaccggggaccgggtacggggtaaccgaacggtccgtacggtacccggtcccgtaagggtcccaccgggacccgtaaccggtccgtaccccggtccccccggttcggtacccctaccgttacccgttccccgtttacccccctaccccgttacccctaccccgtaccgttaaccccg

SEQ ID NO: 60254 - DNA, 932 bp, Homo sapiens
  misc_feature: GYAE6OF01B65B9.43.87.H10.1.454.CMB.1.raw
  modified_base (698)..(698): a, c, t, g, unknown or other
  misc_feature (698)..(698): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcacgccaccctcggtgtccaagggtcttgagacagaccgccacactcacctgacacgtagggaacagacaacaatggttacggaccaaaaccgaagggacgacgtaacggtccgtttacggggccttacgggaccgtaacggcccgaaacggaccccgtaaaccccgggaaccgggggaccccccctaaaccccccgttaaccccccgtaaaaacccgtttacccccgtttaaaacccttaaccccccgttaaaaccggaaaaccgggtaaaaacccgtttaaaaaccccccggtaaaacccccggggtaccccccgtttaaccggaaacgggggtaaccctttaacccgttaaccggaaaacggtaaacggtaaacggttaaacctttttaacgtcccggttacggtaaccctaaccgttaccccggtaaacgggttacgaaaaccgggtaaaacccaacggtaacccgttcccgtaacccgtacggaacccttaacgtttaccggtacgacccttaccgacgtaccgtaggaacggacgtacggtctacgtaacttacgttacncgtactacgaggtactaaggtcggacgtacgaccgtacgtaccctggtaacgtttcgggtcggtttcgggtaccgggtccgggaacgggtaccgggtaaccgtaacggtcggtaacgtaccggtaccgtacggcctaacggacccgttaagtccccgtaccccggcccgttccgggtacctcctttacccgtacccgttaccccctacccgttccaaaccggtccctaacccgg

SEQ ID NO: 60255 - DNA, 704 bp, Homo sapiens
  misc_feature: GYAE6OF01A61CL.43.87.H10.1.454.CMB.1.raw
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccacccgtcggtgtccgaagggcttgagacagaccgccacactcacctgcacgtgggaacagactaacaatgttggacaaccgaaggagcagcttggctgcagcagcaccgagggcccacccgtacccaaactcctaactaccgtaacaggaactaaccgaacccggtccctacgacgggacttcgacgagacgtagtacttagttcacgtctacgtccgaaggtacgaacgaaacacgacgtccctaccgtacgaacctagttaaccgtcgaacctaccgacgtacccgtaggaaacgggtaccgacggtacgtacgtaacttacgttacgtcgttaccgacgtaacgtcgtaaggtacgggaacctaggccgtaaccgttcgtacgtaaaggttcgggtaaccgggtttggggtaccggtttacggggaccgggttaacgggaaccgtacgtacggttacgacccgttaaccggttacgacgtaccggacccgtaacggtcccgccgttccccggtacgtccacccttaccgttcctaccccgtaccctaccttacgaccttacccg

SEQ ID NO: 60256 - DNA, 731 bp, Homo sapiens
  misc_feature: GYAE6OF01BVYSV.43.87.H10.1.454.CMB.1.raw
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcacgcccacccgtcggtcgtaccgaagggtcttgagacacgacccgcacactccacctgacacgtagggaacagactaacgaagttggttacggaccaaaccgaaggacgactaggtcgttggctaggaccagcgacgacgaccggaccggaccctaccctaccaacctcctaactaccaagaacgaactaaccgacccggacctaggacggtactacacgagtaagatactttancgtacganactacgtacgaacgaagaacaccgccgtacctaccgagtaacctattacgacgacctaccgagtccgaggaacggagtacgactacggtaacttacttacgagtacctacgtacgacgaacgggtacggacgacgtaccgaccggtaccttaggcggtttacggtcgggtttacggggttcgggttacccgggacggggaaccggtaaccggtacgtaccggtaccggtaccggtaccggtacgtacccgaccggaccgtaaccgggtcccctcccggtaccccttcgggacccctccgtttacccgtaccccgtttaccccgtacccctacggttacccctaccgttaaccccg

SEQ ID NO: 60257 - DNA, 855 bp, Homo sapiens
  misc_feature: GYAE6OF01BTMF3.43.87.H10.1.454.CMB.1.raw
  modified_base (238)..(238): a, c, t, g, unknown or other
  misc_feature (238)..(238): n is a, c, g, or t
tcagtgtgagtagtcacgaccggtgctcgatttagcagtactgcgttggggtttgggagggtggccctgggctctgctcctcctgaccctcctcactcactctgcagtgtcagtgtccaggcgagggctgactcacgccgacccgtcggtcgtccgaagggtccttgacgacacgaccgccactacctcaccgtgacacgtaggacacgacaactaagtcggtacggacaacgaggancgagtcgttgctgcagcgacgaccgaaccgtaccggacctaccctaaccgaacctccgtactacctaacgaacgtaacctaaccgacccgccgtacgacggtacctacgaacgacggtaacggtacttacgttacctacgtacgaaccgtttaaccaccgggttaaaggaaaccccgtaaacggtaaaacccgcccggttaacccgtcccggtaaccccttacggtaaacccttacgtaaccccgggttccaccgttaacccggaccgttacgggtacggtaaccggtacggtaacggtaccgttaacgtaaaccgtttaacgttaaccccggtgaacccgttacgtacgggaacctttaaaccgggggacgtacgggaaccgtaccgtaccgttacccggtcgggtacggtttacccgggtggggttttacgggtaaccgggtaccggggaccgggtacgtaaacccggtcggttaaccgacccggttaccgttaaccggggttcgaccccgtacggacccggtacgtccccgttcccgtaaccccgggttcaccccgttttccggaccccgtttaccccgtaccccctccggtaaccctttccgaaccgttaccg

SEQ ID NO: 60258 - DNA, 672 bp, Homo sapiens
  misc_feature: GYAE6OF01CTZSN.43.87.H10.1.454.CMB.1.raw
  modified_base (236)..(236): a, c, t, g, unknown or other
  misc_feature (236)..(236): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcacgccacccgtcggtcgtccgaagggtcttggaagacacgaccgccacactcacctgcacgtgggaacagacaacaagtcggtacggacaaaccgaagggacncgagtcgttcggctgcagccgacgccaccgacggccctaccctaaccaaacctcctaactacctaacgaacgaactaaccgaacccggcctacgaggactcgtacgagagagaattatctgcactacgagtacaacggaacacaccgaccctaccgtactacctaacttacgtccggaacttacccgacggtacctaggacgggacggacgcgtaacgtaaccgtttagtaccgtcgtacgtacgtaacgtcggtaacgtcgggactacggaccacgtcctacgtacggtcgtcgggtttcggggtacggtccggggacgggtaccgggacgtaacgtccgtacggacccgttacgtacggccgaccgtccgacggtacctccccgtccggttcgcctaccttcgtccctacccgtccccttacgtctaacctccg

SEQ ID NO: 60259 - DNA, 717 bp, Homo sapiens
  misc_feature: GYAE6OF01DWYI4.43.87.H10.1.454.CMB.1.raw
  modified_base (220)..(220): a, c, t, g, unknown or other
  misc_feature (220)..(220): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagcccacccttcggtgtccaagggcttgagacagaccgccacactcacctgcactgggaacagcaacaatgtcggacaaccaaggancagcttggctgcagcagcaccacggccaaccctccaaactcctaatccctaacaggaactaaccaacccggccctacgagggactcctcaaggacgagtatttaacgtctagactactaccgtaggtaccaaacggaaaaccaacaaccgtcccgtacccctagaacccctaagtttaaccgtcgggtaaccctaccgacgtccgtagggaacggacggacgggtactacgtaacttaacgtttacgtacgtaccttagacgacgtacggtacgggacgaacgtccgaacgtcccttagacggttcggttacggtttggggttcggttaccgggacgggaaccgggtaaccgaaaggtccgtacggtacccgtccgttaacgggtacgaccgggtacccgtaacgggtcccgttcccgaccccccggttcgtacccgtacccgttcccgttacccggttccccccgtacccctcccgttacccgacgttaaaccccg

SEQ ID NO: 60260 - DNA, 522 bp, Homo sapiens
  misc_feature: GYAE6OF02GL3FP.43.87.H10.1.454.CMB.1.raw
  modified_base (352)..(352): a, c, t, g, unknown or other
  misc_feature (352)..(352): n is a, c, g, or t
  modified_base (384)..(384): a, c, t, g, unknown or other
  misc_feature (384)..(384): n is a, c, g, or t
tcagtgtgagtagtcacgaccggtgctcgatttagcagtactgcgttggggtttgggagggtggccctgggctctgctcctcctgaccctcctcactcactcctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccacctcccaaactcctatcctacaggaataacaaccggccctcagggatcctcagacgagattagtctgcatccgaggtcaggaaacacagcctcctgaccattacnggactcagtcctggagacgagctgactatacngctcagcagtcggacagcagcctcgagtgcgttgggtgttcggcggaggaccagctcgaccgtctaggtcacgcccgaggcctcggcccccgtggtccacgtccgttccggttccccggccctccgtccacgtacccg

SEQ ID NO: 60261 - DNA, 559 bp, Homo sapiens
  misc_feature: GYAE6OF02GOV3A.43.87.H10.1.454.CMB.1.raw
  modified_base (217)..(217): a, c, t, g, unknown or other
  misc_feature (217)..(217): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggancagcttggctgcagcagcaccaggccaccctcccaaactcctatcctacaggaataacaaccggccctcagggatctcagagagattatctgcatccaggtcaaggaaacacacgcctccctgaccatttactcggactccacgcctaggaggacgaggctgactattactgctcagcagtcgggacagacacgcctcagtcgtacgttgggttgttcgggcgggacgggaccgaggcgtcggacccgttcgtacggtacgacgacccgaacggtcctaccgcccccgtcggtcctacgttccgttccgttaccccgtaccctcccgttacctacctacccg

SEQ ID NO: 60262 - DNA, 576 bp, Homo sapiens
  misc_feature: GYAE6OF02I14R1.43.87.H10.1.454.CMB.1.raw
  modified_base (217)..(217): a, c, t, g, unknown or other
  misc_feature (217)..(217): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggancagcttggctgcagcagcacaggccaccctcccaaactcctatcctacaggaactaacaaccggcctacagggatctcagagagattatctgcatccaggtacaaggaaacacacgcctccgtagaccattactggacctcagcctaggacggacgagctgactattacgngctcagacagtggacngacacgacctcagtcggcttaggggttgtccgggtccgggaagggacccgtaaggcctacggacccggttacgtacgggttccgacggacccgaacgggccttcccggacccccgtcgtacccgtacctccgttacccgttcccctaaccccgtccttacctaccgtaaccc

SEQ ID NO: 60263 - DNA, 559 bp, Homo sapiens
  misc_feature: GYAE6OF02HWCNK.43.87.H10.1.454.CMB.1.raw
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaaacaatgttggcaaaccaaggagcagcttggctgcagcagcaccaggccaccctccaaaactcctatcctacaggaaactaaccaaccggccctacgagggactctacagagagtattatctgcatccaaggtcaaggaaacacacgccctaccncaccattacnggactcacgctgaggcgagctagactatactgctacagcagtacggacacgcgacgcctacgagtcgacggtttgggttacgttcgggacgggacggtaccgaagtccgtacgtacccgtacgtacggtccgacggtaccgacggctccgccccgtcgtccacgtctcccgttaccctaccctcctacctacctaccc

SEQ ID NO: 60264 - DNA, 565 bp, Homo sapiens
  misc_feature: GYAE6OF02HYOWM.43.87.H10.1.454.CMB.1.raw
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcacgaggccaccctccaaactcctatcctacaggaactaacaaccggccctacgaggactctcagagagattatctgcatccaggtcaaggaaacacaacgcctcctgaccatttacnggactcagtcctgacggacgacggctagactattacngtctcagacagtgggacagcgacgccgtcgagtgcgttgggtcggtcgggcgggacgggaccgaaggcgtcgaccgtcgtacgtcgacgacccgacggtccgtaccgtccccggtcggttccacccgttcgttcccgtttccccggacccctttcccgtacccctacgttaccccg

SEQ ID NO: 60265 - DNA, 736 bp, Homo sapiens
  misc_feature: GYAE6OF02FNIPC.43.87.H10.1.454.CMB.1.raw
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggacaaccaaggagcagcttggctgcagcagcaccgacggcccaccctacccaaactcctatcctacacggaactaaccaaccggccctacgagggactcgtacgagacgagtattactctagactacgtaccgaaggtacaaacggaaacaccacgtccctacccgtacgacctaacttaccgtacggtaacctaccgacgtccgtaggaacggaccgaacggtctacggtaacttacgttacgtcgtacgttacgacgtacgtacggtacgggaaccgtaggtaccgaccgttaccgtaccggtacggttacgggttcgggtttacgggggtccgggttaaccggggaccgggtaaacgggtaaccgtaacgggtaccgttaccggtacccggttacggtaaccggtaccgtaaccgggacccgtaacgggttccccgtacccggttcccccggttaccggtacccgttaccgtttcccgttccccggttacccccttcccgtttacccgtacccgtacccttaaccccg

SEQ ID NO: 60266 - DNA, 735 bp, Homo sapiens
  misc_feature: GYAE6OF02J068Z.43.87.H10.1.454.CMB.1.raw
  modified_base (216)..(216): a, c, t, g, unknown or other
  misc_feature (216)..(216): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactggaacagcaacaatgtggacaaccaaggancagcttggctgcagcagcaccgacggcccaccctaccaaactcctatcctaacacggaactaaccgaaccggccctacgaacgggtatccgtacaacgaagagtaattatcgtcgacactaccgaaggtccgaaaggaaaacctacgacgtcccttaccctacggaaccctaacgtttaccgtaggaccttccgaacgtacccgtggacggtaaccgtaggctacgtaacgtacttaccgtaggacctaccggtacgaccgtacggtacggggaacctacggtaccacggtacccctacgtaacggttccgtacggttttacgggggttacgtttacccgggggacggggtaaccgggtaacccgtaaacgggtcccgttacgggtaaccccggttccgtaacggggtacccgaccggcccggtaaacggccccgtacccggaaccccggtttccggtaccgtacccttccggttacccgttcccccgtaacccgtttcccctacggttaccctaaccg

SEQ ID NO: 60267 - DNA, 605 bp, Homo sapiens
  misc_feature: GYAE6OF02I8B8K.43.87.H10.1.454.CMB.1.raw
  modified_base (416)..(416): a, c, t, g, unknown or other
  misc_feature (416)..(416): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccgaggcccaccctcccaaactcctatcctaacaggaactaaccaaccggccctacgacgggactcctacagagacgattatcgtgaccatccgaaggtcgaacggaaacacgacgccctaccctagacctattactcggacctccacgcctaggaggacgacggctagactacttacgngtctcgagcagtagggacctagcacgtccagtacgtcgtcggttgggtcggttccgggacgggacggaccgtacgcgttacggacccgtcgtacgtaccgacgtacccgaggtccctccggtaccccgttcggtacccgtaccgttccgttcccgttccccgccccttacccgtaccgtaccctacccg

SEQ ID NO: 60268 - DNA, 657 bp, Homo sapiens
  misc_feature: GYAE6OF02G75TZ.43.87.H10.1.454.CMB.1.raw
  modified_base (215)..(215): a, c, t, g, unknown or other
  misc_feature (215)..(215): n is a, c, g, or t
  modified_base (352)..(352): a, c, t, g, unknown or other
  misc_feature (352)..(352): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacatgtgacaacaaggacncagcttggctgcagcagcgaccgacggccacccctaccaaactcctactaccaacaaggaactaaccgaccggaccctacgacggactctagaacgagaagtacttactcgagactactccgaggtacaaggaaacncacgtcctacctacgaacctactttacgcgtacctacgacgtccgtaggaacggacgacgtacgtacgtaacttacttacgtcgcctacgaagacgtacggtacgggaactacgacgtaccgacgttcgagttcggtacgggttacggggttcgggttaccgggacgggtaacgggaaccgtaacggtcgtaccggtaccggttacgaccgggttacgaccggtaccgtaacggggcccctcccggtcccgtcggtaccctaccgttcccgtccggttcccctcccgtcctaccgtacctacccg

SEQ ID NO: 60269 - DNA, 662 bp, Homo sapiens
  misc_feature: GYAE6OF02G5X8P.43.87.H10.1.454.CMB.1.raw
  modified_base (191)..(191): a, c, t, g, unknown or other
  misc_feature (191)..(191): n is a, c, g, or t
  modified_base (249)..(249): a, c, t, g, unknown or other
  misc_feature (249)..(249): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagtgtgagtagtcacgaccggtgctcgatttagcagtactgcgttgggtttgggagggtggcctgggctctgctcctcctgaccctcctcactcactctgcagtgtcagtggtccaggcagggctggactcagccacctcggtgtaccaagggcttgagacagtaccgcacactcactgcactggaacncgacaaactaatgtacggacaaacaaggagtcaagtcgttaggctacgcaggaccaanccaacgtacggccctaccctaccaaacgtccaactccaacgaaggaaataaccgaaccgcctagaacggctcacgagaagataatctcncnacgtcagacaagttaaaccncgacncctaccanaactacgtaacgacgtactacccgaagtctaaggaacgacgacggtactacgtaacttaattacgcgtactaccgacgacgtagaacggactagacgtacgtctagacgtgtacgggttacgggttacggtacgggaccgggaacgtaaccgtacgtacgtaccggtaaccggttacgaccggttaccgaccgggtaccgtaccggtaccggttccccgaccgttaaccggttcctaacccggttcccttacccgtaccccgttaccccgttaccaccgttaaccgtcc

SEQ ID NO: 60270 - DNA, 777 bp, Homo sapiens
  misc_feature: GYAE6OF02FUPYF.43.87.H10.1.454.CMB.1.raw
  modified_base (173)..(173): a, c, t, g, unknown or other
  misc_feature (173)..(173): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccanactcactgcactgggaacagcaaacaatgttggacaaaccgaaggagcagtcttggctgcagcacgcaccgaggacccaccctacccgaaactcctaacacctaacgaacggtaaactaaaccaaacccggcccctacgaacgggtaacttccgacaaggagaacgtaagttaattcgtacgactacgtaccgaacgggtacgaaacggaaaacacaccgtaccctcccgttaacgacctaacttacgtacggaacctccctacgtaacccgttagggaacggggtaacggaacggaccgtacgttaaaccttaacgttaacgtcgtaccgttaccaacgtacgtaacggtacgggaaacgacggaaccacggtacccgtacgtacgggttcgttcgggttcggggtttcgggttaccggggtaccggggtaaacgaaacccggtaacggttccgtaaccgggtaacccggttacccgtaacgggtacccgacggaacccgtaaacgggtccctacccgggttacccccgttcccggtacccgttacccgtttacgtaccccggtttacccttacccccggtaccttacctacccggttaaccc

SEQ ID NO: 60271 - DNA, 739 bp, Homo sapiens
  misc_feature: GYAE6OF02GWTAG.43.87.H10.1.454.CMB.1.raw
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggacaaaccgaaggagcagcttggctgcagcagccaccgaggcccacccctaccctaaacctcctaactcctaacaggaactaaaccgaaccgcccctacgaagggacttccgacaggaacgagtacttaatcctcgacatacccgaggtccgaaaggaaccacaccgccctacccgtagaccctaatttaccgacggaccttaccggaacgtcccgtagaacgggtaccgagtcgtacggtaactacttacgtcgaactcgaacgtaccaggtaccgggactaacgacgtaccggacttccgtaacgggttcgtaccgggtttcggggttacgggttaccgggaccggggttaaccgggaccggtaaccggttccggtaccggtaaaccccggtttaccgggttacgggtaccccgtacggaacccccggttaagggcccctcccgggttaccccccgttacggtcccgtaccgtttacccggttcccccgtttaccccgacccccgtttaccctacccttaaccggtaccccc

SEQ ID NO: 60272 - DNA, 655 bp, Homo sapiens
  misc_feature: GYAE6OF02H8VEZ.43.87.H10.1.454.CMB.1.raw
  modified_base (174)..(174): a, c, t, g, unknown or other
  misc_feature (174)..(174): n is a, c, g, or t
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (408)..(408): a, c, t, g, unknown or other
  misc_feature (408)..(408): n is a, c, g, or t
  modified_base (482)..(482): a, c, t, g, unknown or other
  misc_feature (482)..(482): n is a, c, g, or t
tcagtgtgagtagtcacgaccggtgctcgatttagcagtactgcgttgggtttgggaggtggccctgggctctgctcctcctgaccctcctcactcactctgcagtgtcagtggtccaggcagggctgactcagcccaccctcggtgtcccgaaagggcttgaggacaggaccnccaacactcacctgcactgggaacagacaaacaatggttcggaccaaaccgaaggagacagtcttggctgccagccagccaccgaggcccaaccctaccaaacctcaatccctaanaaggaactaaccgaccgcctagaggctacgtnaagagagtattacnctagactacgaccgtaaggtacaacgaaacgtcaacgtcccttacctagacctatacgacgtacctcgaacnccgaggtaacgacgtacggaccttacgaacttaacttacgtcgtacgtacgtacgtacgtaacggtagggaacncgaacgtaccgtacctacgtaggttcggtaacgttgggttaccggtccgggacggaacggactaacggacgtaaccgacgtaccgtacggtactaccgaccgtaacggtcccgtacccgtcccgaccgttccaccgttcgtacccgtaccctaccctcctaccctactacccg

SEQ ID NO: 60273 - DNA, 780 bp, Homo sapiens
  misc_feature: GYAE6OF02F09EM.43.87.H10.1.454.CMB.1.raw
  modified_base (462)..(462): a, c, t, g, unknown or other
  misc_feature (462)..(462): n is a, c, g, or t
tcagtgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggacaacgaaggagcagcttggctgacagcacgcaccgacgggcccaccctacccaaactcctactcctaacgaggaactaaaccaacccggccctacgagggactcgtacagagacgtaattactctacgacctacgtacccgtaagggtacgaaacggaaaaccaccgacgtacccctaccgtacgaaccttacgttacgtcggacctaccgacgccgtaggaggaccgcggtacgtacgtaacttaacgtttacncggtaccttacgacggtacgtaacggttacgggaaccgtaacggccgtaccgtaccccttagtacggtttccggttaccggggtttaggggtttccgggttacgggggtaccggggtaaccggggaaccgtaacgggttcccgtaccggttaaacccgggttcccggttaacggggtccgtaaccggtaaccccgggacgggtccccggttacccccggtccccggtttacccgggtaccgttaacccggtttcccggttaccccggttttacccccgaacccccttttacccggttaccccttacccgttaaccccg

SEQ ID NO: 60274 - DNA, 527 bp, Homo sapiens
  misc_feature: GYAE6OF01A53ET.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggatgccagataggttcagtggcaggcgggtcaggcacagtatttcacactagaaaatcgagccgggtggaggcgtgaggtagttagttgggtttattacgtgctatgtacgtaaggttacttttccgttacgtggtacggttcggaccgtaaacgggaccgtaagggtaggaaacgtcgaacgacgaacgtgtacggactcgcgaccgtacg

SEQ ID NO: 60275 - DNA, 499 bp, Homo sapiens
  misc_feature: GYAE6OF01C9J4R.17.4.A04.1.454.CMB.1.raw
  modified_base (426)..(426): a, c, t, g, unknown or other
  misc_feature (426)..(426): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggagtgccagataggttcagtggcaggcgggtcagggcacagatttcacactgaaatcagccgggtggaggctgaggagttagttgggtttattacgtgcatgctaaggttnttttccgttccggtggtacgttcggccgaagggaccgaaggtaggaatcacacgaactgtaggntgcnctacg

SEQ ID NO: 60276 - DNA, 567 bp, Homo sapiens
  misc_feature: GYAE6OF01CKX7L.17.4.A04.1.454.CMB.1.raw
  modified_base (283)..(283): a, c, t, g, unknown or other
  misc_feature (283)..(283): n is a, c, g, or t
tcagcgtagactagcacgaccggtgctcgatttagagtagtgatcaggacttctcagttcatcttctcaccatgaggctccctgctcagctcctggggctgctaatgctctggatccctggattcagtgcggatattgtgatcgacccagactccactctctctgtccgtccacccctggacagccggcctccatcctcctgcaagtctagtcagacgcctcctgcatagtgataggaaagaccttatttgtattggtacctgcagagcaggccagtctccanatctacctaatctatgtaacgtttccagtcgtattcctcgtgggagtcgaccaagtagttaggtcaggtggacaggcgggtcaggcacgagtatttcactactaagaaatcgacggccgggtaggaggtcgtaggaaggtatttaggtttaggggttttaattacgtgtactagtgtacgtaaggtttacttttccgttcggtacggtacggttcggaccgtaacgggaccgtaagggtagtaaacgtccgaacgtaacgacgtggtacggctacgcacgtacg

SEQ ID NO: 60277 - DNA, 524 bp, Homo sapiens
  misc_feature: GYAE6OF01EYDI3.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggagtgccagataggttcagtggcaggcgggtcaggcacagtatttcacactagaaaatcaggccgggtggaggctggaggattagtttggggtttaatttacgtgcagtgactaaggttacttttccgttccggtggtacgttcggaccgtaaaggggacccgtaaagggtaggaaatcgaacgaacgaactggtaggctgcacctacg

SEQ ID NO: 60278 - DNA, 556 bp, Homo sapiens
  misc_feature: GYAE6OF01EOJ44.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaaagccttatttgtattggtacctgcagaaggcaggccagtctccacatctcctaatctatgaagtttccagtcgattctctggagtgccagataggttcagtggcaggcgggtcaggcacagtatttcactactagaaaatcgaggccgggtagggaggtcgtaggaggtattagtttaggggttttaattacgtggtactagtgtacgttaaggtttactttttaccgttccggttaggtaccggttccgggaccgtaaacgggtaccgtaaagggttaggaaactcgaacgaacgaacgtggtacggactgccacgtacg

SEQ ID NO: 60279 - DNA, 605 bp, Homo sapiens
  misc_feature: GYAE6OF01DWYDK.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagtccttatttgtattggtacctgcagaaggcaggccagtctccacatctctaatctatgtaagtttccagtcgtattctcgtggagtgaccagtataggttcaggtggcaggcgggtcaggcacagtatttcactactagaaaatcgaggccgggtgggaggtcgtaggaggtagttaggtttaggggtttaattaacgtgtactagtacggtacgttaaaggtttactttttacccgttaccggttacgggtaccggtttaccggggacccgtaaacggggtaacccggtaaaggggttaacggtaaaacgttcgaaccgtaaacggtaaccgttaggtacgggtacctcggtaccgtaacccgtaacg

SEQ ID NO: 60280 - DNA, 548 bp, Homo sapiens
  misc_feature: GYAE6OF01C2OV4.17.4.A04.1.454.CMB.1.raw
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaaagacctatttgtattggtacctgcagaaggcaggccagtcnccanatctcctaatctatgaagtttccagtcgattctctggagtgccagataggttcagtggcaggcgggtcaggcacagatttcacactagaaatcaaggccgggtggaggcgtgggagtagtttaggtttaggtttatacgtgtatagtgtacgtagtttacgttttccgttcggtacggtacggttaccggaccggtaacgggtaacgtaagggtaagtaaacgtacgaaccgtaacgtaacgttggtacgtcgtacgcctaccgtacg

SEQ ID NO: 60281 - DNA, 551 bp, Homo sapiens
  misc_feature: GYAE6OF01C357P.17.4.A04.1.454.CMB.1.raw
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaagtacctatttgtattggtacctgacagaggcaggccagtctccanatctcctaatctatgtaagttccagtcgattctcgtggagtcgaccagtattaggttcaggtggcaggcgggtcaggcagagtactttacacactagaaatcgaaggccggggtagaggcgtaggagtagttagtttaggggtttattagtgactagtgtactaaggttacttttccgtcgtgggtaccgttcggaccgtaaggggaccgtaagggtaggaaacttccgaacgtaacgacgttacggtaggactagccgtaaccgtaacg

SEQ ID NO: 60282 - DNA, 685 bp, Homo sapiens
  misc_feature: GYAE6OF01C70I5.17.4.A04.1.454.CMB.1.raw
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaatacctatttgtattggtacctgcaagaaggcaggccagtcncacatctacctaatctatagtaacgtttccagtcgattctacgtggacgttgaccgtagtagttacggtctaagggttcggacaagggtccggggtacacgggtaccaacgtaggtactttaccgaacgtaacgtaagtaaaacgtcggaacgggtacccggggtagggacgggtaccgttagggaagggttaagtttaagggttttacggggttttaattaccggttggtacctaagttacgggttaacgttaaagggtttaccgttttttacccggttaccgggttacggttaccggtttaccgggtaaacccggtaaaggggtaaacccggtaaagggttaagggtaaaactccgaaacgtaaacggtaacgttcgggtacggtacgtcgaccgtaccgttacg

SEQ ID NO: 60283 - DNA, 551 bp, Homo sapiens
  misc_feature: GYAE6OF01EBDR1.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctactaatctatgtaatttccagtcgtattctctggatgccagtataggttcagtggcaggcgggtcaggcacagtattcactactagaaatcgaggccgggtaggaggtctaggagtagttagtttagggtttattacgtgctagtgtacgttaaggttacttttccgttcggttcggtacggttaccgggaccgtaaacggggaaccgtaagggttaggaaacgtccgaacgtaacgaaccgttggtacggactacgccgtacgtacg

SEQ ID NO: 60284 - DNA, 598 bp, Homo sapiens
  misc_feature: GYAE6OF01CCLYZ.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagaccttatttgtattggtacctgcagaaggcaggccagtctccacatctcctaatctatgtaagtttccagtcgattctctggagtgccagtataggttcaggtggcaggtcgggtcaggcacgagtatttcaacactagaaaatcgaaggccgggtgggaggcgtaggaggtattaggtttaggggtttattacgtgactagtcggtacgtaaaggtttacttttacccgttccggttacgggttaaccggtttccgggacccgtaaacgggggtaaccgtaaacgggtacggtaaaacgtccgtaaaccgtaacggtaaaccgttcggttacgggtaccgtacgtaccgtaaccgttaacg

SEQ ID NO: 60285 - DNA, 521 bp, Homo sapiens
  misc_feature: GYAE6OF01BSYCG.17.4.A04.1.454.CMB.1.raw
  modified_base (359)..(359): a, c, t, g, unknown or other
  misc_feature (359)..(359): n is a, c, g, or t
  modified_base (511)..(511): a, c, t, g, unknown or other
  misc_feature (511)..(511): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaacgtttccagttcgatttctctggagtgccagtataggttcagtggcaggcggtcaggcaaacngtattcacactagaaagtcaggtccgggtgaggtcgtagaggtagtagtttgggtttattacgtgactagtgtacgtaggtttactttccgttcggtggtacggttcggaccgtaagggaccgaaggtaggaatcgaacacgacgtcggagntcgcacgtac

SEQ ID NO: 60286 - DNA, 576 bp, Homo sapiens
  misc_feature: GYAE6OF01D7FF3.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagccttattgtattggtacctgcagaaggcaggccagtctccacatctacctaatctatgtaagtttccaagtcgtattctcgtgggagtgccagtattaggttcaggtggcgaggccgggtcagggcaacgagtactttcactactagaaaatcgaggccgggtggaggctgaggtattaggtttaggggtttacttacgtgctagtaggtacttaagggtttacttttccgttccggttcgggtaccggttcgggaccgtaaagggtaacccgtaaagggttaggaaacgttcgaaccgtaaccggtaaacgttcggtacgggctcgcccgtacgtaacg

SEQ ID NO: 60287 - DNA, 693 bp, Homo sapiens
  misc_feature: GYAE6OF01DZYSR.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagacgcctctgcatagtgagtaggaaacgtaccttagtttgtagttcggtacctgacaaggaacggcgacggccagtcctaccactactcctacctaatctatagtaacgtttccagtcgtattctcgtggagtcgaccgagtacgttaggttcgaagggtcggcgtaagggtccgggttacgaacgggtacctaacgaaggttacttttaaccgaacgtaaacgtaagtaaaacgttacgaacgggtacccggggttagggacgggtccgttagggaaggttaagtttaacgggttttaggggttttaacttacggtgtacgttagtacggtacgttaaacggttttacgtttttacccggttaccgggttacgggttaccggtttaccgggaacccggtaaacggggtaaccgtaaagggtaacggtaaacgttcgaaaccgtaacgtaacgttcggtacggtacgtcgaccgtacgtacg

SEQ ID NO: 60288 - DNA, 555 bp, Homo sapiens
  misc_feature: GYAE6OF01DP1JD.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcaccctggacagccggcctccatcctcctgcaagtctagtcagagcctcctgcatagtgaatggaaaagaccttatttgtattggtacctgcagaaggcaggccagtctccacatctcctaatctatgaagtttccagtcgattctctggagtcgccagtattaggttcaggtggcaggcgggtcaggcacagtatttacacactagaaatcgaggccgggtaggaggcgtggaggtattaggtttaggggtttaattacgtgctagtggtacgtaaggtttacttttccgttcggttacggtaccggttccgggaccgtaacggggaaccgtaaagggtaggaaactccgaacgacgtaacgtcggtaggacgtgcctacgtacg

SEQ ID NO: 60289 - DNA, 549 bp, Homo sapiens
  misc_feature: GYAE6OF01EFR67.17.4.A04.1.454.CMB.1.raw
  modified_base (220)..(220): a, c, t, g, unknown or other
  misc_feature (220)..(220): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctcatctcctgcaagtctagtcagacgcctccngcatagtgatggaaagaccttatttgtattggtacctgcagaaggcaggccagtctccacatctcctaatctatgtaagtttccaagtcgattcgtctggagtgaccaagtattagggttcaggtgggcaggcgggtacagggcacgaagtatttacgactactagaaaatcgaggccgggtggaggcgtaggagtattagtttggggtttattacgtgcagtgtacgtaaggttacttttccgttccggttggtaccggttcggaccgaagggaaccgtaaggtaggaaactcaacgaacggtaacgtggtacggactcgccactacg

SEQ ID NO: 60290 - DNA, 779 bp, Homo sapiens
  misc_feature: GYAE6OF01BAVBK.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaagaccttatttgtattggtacctgacaggaaggcagggccagtctccacactcctacctaatctatgtaagtttccagtcgtattctcgtgggagtcgaccgtaagtaagttacgggtttaccgaagggttcgggaccgtaacggggtcccgggggttaccaacgggggtaccctaaacggtaacggttaacgtttttaccaaaccgtaaccgttaaaggtaaaaaacgttccggaaacgggtaccccgggggggtagggaacggggtaccgttagggtaacggggtaagttttaagggtttttaggggggtttttaaactttacggtaggtaccgtaaggttacgggtaaccggtttaaacgggttttacccgttttttacccggtttaccggggttacggggttacccgggtttaccggggaacccgggtaaaacgggggtaaccccggtaaaaggggttaacgggtaaaaacgtaccggtaaaccgaaccgggttaaacgttgggttacgggtaccgtacggtacccgtaacccgttaacg

SEQ ID NO: 60291 - DNA, 627 bp, Homo sapiens
  misc_feature: GYAE6OF01EW6NG.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaagtaccttatttgtattggtacctgcagagcagccagtctccacatctactaatctatgaatttccagtcgattctcgtggagtcgaccagtagtacggttcaaggttcggcaggcgggtcaggcacgagtattacactactagaaatcgaggccgggtggacggtcgtaggtaggtaagttaggtttaggggtttaacttacgtggtactaagttcggtaacgttaaacggtttactttttaccccggtttaccgggttacgggttaaccgggtttccgggtaacccggtaaaggggtaaacccggtaagggtaagggttaaacgtacccgtaaccggtaaacgtaaaccggttacgggtacggtaccgttacggtaccacccgttaacg

SEQ ID NO: 60292 - DNA, 646 bp, Homo sapiens
  misc_feature: GYAE6OF01A3D93.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagacgcctcctgcatagtgatggaaagtccttattgtattggtacctgcaggagcaggccagtctccacattcctacctaatctatgtaaagtttcccaagttcgtaatttcgtcgtagggatcgacctaggagttagggttcaggttggcgaaggtccggggtcaagggacctacgtaacgttactttaccaactaacgtaagaaaacgttcgaacgggtaccggggtagggaggtacgtacggtaaggttacgtttaagggttttcggggtttaacttacgttgtacgtaagtcggtacgttaacggtttaccttttacccggttacggtacgggttaccggttacggacccggtaaacggggtaacggtaacggtaaggtaaacgtctaaaccgaacggtaacgtcgggttacgacctcggaactacccgtacg

SEQ ID NO: 60293 - DNA, 758 bp, Homo sapiens
  misc_feature: GYAE6OF01BXWRQ.17.4.A04.1.454.CMB.1.raw
  modified_base (220)..(220): a, c, t, g, unknown or other
  misc_feature (220)..(220): n is a, c, g, or t
tcagcgtagactagcacgaccggtgctcgatttagagtagtgatcaggacttctcagttcatcttctcaccatgaggctccctgctcagctcctggggctgctaatgctctggactccctggatccagtgcgatattgtgatgacccagactccactctctctgtccgtcaccctggacacggccgcctccatcctcctgccaagtctagcagcgcctcngctatagtgataggaaaatccttagtttgtattcggtacctgacaaggaagcacggccagtcctacccatactctacctaatctatcgtaagtttccaagtcgtattccgtgtaggatcgacctaagtagttaagggttcaagggttcgacgtaagggtccgggtacaagggacctaacgtacgtactttaccaacgtaaccgttaaagtaaaactaccggaaacgggtcccgggggttaaggaacgggtaccggttagggtaaacgggttagttttaagggttttacgggggtttttaacttaacggtcggtaaccgttaaggttacgggttaaccggtttaaaacgggtttttccgtttttaccccggttaccgggttaacggggtttaacccggtttaccggggtaaacccggtaaaacgggggtaacccgttaaaaggggtaacgggttaaaacgtacccgaaaccggttaaaccggttaaacgggtttcgggtaacggggtaccttaaccggtacccgtaaaccgttacccgg

SEQ ID NO: 60294 - DNA, 567 bp, Homo sapiens
  misc_feature: GYAE6OF01EJU67.17.4.A04.1.454.CMB.1.raw
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacacgccggcctccatctcctgcaagtctagtcagacgcctcctgcatagtgataggaaacgtaccttatttgtattggtacctgacagaaggcaggccagtcnccacatctacctatctatgtattccagtcgtattctcgtggagtgcagtagtacggttcaggtcgcaggcggtcagcgacagtattcactactagaaatcgaggtccgggtaggacggtcgtggtaggtaagttaggtttaggggtttattacgtgtactagtgtacgttaacggttacgttttccgtcggttcggtacggttacgggaccgtaaacgggtaccgtaagggttaaggtaacgtaccgaacgaaccgtaacgtcggtacggactcgactaccgtacg

SEQ ID NO: 60295 - DNA, 579 bp, Homo sapiens
  misc_feature: GYAE6OF01ETFJJ.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaacgtaccttatttgtattcggtacctgacagaaggcaggccagtcctcacatcctactaatctagtgtaagtttccagttcgtattctcgtggatcgaccagtattaggttcaggtggcaggtcggtacagggcacagtatttacactactagaaatcgacggcgggtaggaggtcgtaggaggtaagttaggtttagggtttaattacgtgtacgtagtagtacgttaacggtttacgttttaccgttcggtacggtaccggttcggaccgtaaagggaccgtaagggtacggaaactcgaacgtacgtaacgttcggtacggtacgtacgtcgaccgtacg

SEQ ID NO: 60296 - DNA, 678 bp, Homo sapiens
  misc_feature: GYAE6OF01C2LS6.17.4.A04.1.454.CMB.1.raw
  modified_base (241)..(241): a, c, t, g, unknown or other
  misc_feature (241)..(241): n is a, c, g, or t
tcagcgtagactagcacgaccggtgctcgatttagagtagtgatcaggacttctcagttcatcttctcacaatgaggctccctgctcagctcctgggggctgctaatgctctggatccctggatccagtgcggatattgtgatcgacccagacctccactctctctcgtccgtccacccctggaccacggcccggccctccattcctcctgacaagttctagtcagactcctcctgcatgngataggaaaatccttattttgagtttacgggtacctggacaaggacggacacggtcccaagttccacccaatactccctaccttaatcttaagtagtaacgtttcccaaggtccgtatttccgtacgtgggacgttacgacctaagtaagttacggtacgtagggtcggggactaggggtccgggtacaagggtaccaacgtacgtactttaccaacgtaacgtaaagtaaaaccgtcgtaacgggccggggtagacgggtcgttagggaaggttagttttaagggtttagggtttacttacgtgtacctagtacgtagttaacggtttcttttccgtcggtacggttaccggttacggaccgtaagggtaaccgtagggtaacggaactacgaaccgtaacgtacgtacggtaggtctaacggcctaaccgttacg

SEQ ID NO: 60297 - DNA, 565 bp, Homo sapiens
  misc_feature: GYAE6OF01EULMR.17.4.A04.1.454.CMB.1.raw
  modified_base (356)..(356): a, c, t, g, unknown or other
  misc_feature (356)..(356): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcaccctggacagccggcctccatctcctgcaagtctagtcagagcctctgcatagtgatggaaagacctatttgtattggtacctgcagaaggcaggccagtcctccacatctcctaatctatgtaagtttccagtcgtattctcgtggagtgaccagtagttaggttcaggttggcaggtcgggtnagggcacgagtattcactacgtagaaaatcgaggccgggtaggaggtcgtagaggtagttagtttaggggtttattacgtgactagtgtacgttaaggtttacttttccgttccggttacgggtacggttaccgggtaccgaacgggtaccgtaagggtaggtaaactcgaacgtaacgaacgtggtacggtacgtcgccgtacgtacg

SEQ ID NO: 60298 - DNA, 679 bp, Homo sapiens
  misc_feature: GYAE6OF01BJK4O.17.4.A04.1.454.CMB.1.raw
  modified_base (224)..(224): a, c, t, g, unknown or other
  misc_feature (224)..(224): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctcgtccgtccacccctggaccacgccggcctccatctcctgcaagtctagtcagacgcctcngcagtagtgataggaaagtaccttagtttgtattggtacctggcagagcaggccagtcctcactatcctctaagtctatacgtaagtttccagtcgtatttcctcgtacggagtcgaccgaagtagttaggtacgtaggttcggcgaacggtcgggtcgacggtacgacctagtacgttcaacgtaactacgtaaaatccggtaggccgggggtagacggtacgtagggtaaggtaaggtttaggttttaggggtttaacttaacgtcggtaacgtagttacgggtacgtttaaacggtttctttttaaccccggttcgggttacggtaaccgggtttacccggaaccggtaaaccggggttacccgtaaaaggggttaggtaaaaacgtttcccgaacggttaaaacgacccgggttggtaccggtaccgtttacaacccggttaaccttaccg

SEQ ID NO: 60299 - DNA, 649 bp, Homo sapiens
  misc_feature: GYAE6OF01C1JG6.17.4.A04.1.454.CMB.1.raw
  modified_base (288)..(288): a, c, t, g, unknown or other
  misc_feature (288)..(288): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatcgacccagactccactctctctgtccgtcacccctggacagccgcctcatctcctgcaagtctagtcagacgcctcctgcatagtgaataggaaaacgtccttatttgtatttcggtacctgacaaggaacggcgaggccagtccnccactactcctaccttaatctaattgtaaacgtttccaagttcgtatttcctctgggtagtcgacctaagtagttaggtctaggtcggcgagggtcgggtacacgggctaacgtaagtactttacgaactaacgtaagtaaaacgtcgaacgggtccggggtagggacggtcgtagggaaggttaggtttaaggttttacggggtttaattacgtagtacgtagttcggtaacgtttaacgggtttactttttcccggttcggttacgggtaaccggtttacggaccggtaaaggggaaccgtaaagggtacgtaaacgtacgaaccgtaacgtacgtcggtacgacttcgacgtacgtac

SEQ ID NO: 60300 - DNA, 623 bp, Homo sapiens
  misc_feature: GYAE6OF01DOMLQ.17.4.A04.1.454.CMB.1.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (345)..(345): a, c, t, g, unknown or other
  misc_feature (345)..(345): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctcgtccgtccaccctggacagccggcctccatctcctgctaagtctagtcagngcctctgacatagtnatggaaactctatttgtattcggacctgacaggagcaggcagtcncanctctctaatcatgaactttcagtcattctacgtggtaagttcgaccgaagtaattcggggtttaacnggtcggacgacgggtcgggtacgacggtaccaagtaacgtaactttaccgaactaacgtaacgtaaacgtacggacgggtccggggtagggacggtacgtagggtaacggttaaggtttaggttttagggtttacttcgtagtacgttagtagtacgtttaggttttaccttttcccggttacggttacggtaccggttcgggaaccgtaacgggaacgtaagggtaagtaacgtacgaacgtaccggtaacgtcggtacggcgtcgacctacgtacg

SEQ ID NO: 60301 - DNA, 522 bp, Homo sapiens
  misc_feature: GYAE6OF01CK7SN.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtacctatttgtattggtacctgcagaaggcaggccagtctccacatctctaatctatgtaatttccagtcgattctctggagtgccagtattaggtcaggtgcaggcgggtcaggcacgagtatttcacactagaaatcgaggccgggtggaggcgtgaggtattagtttgggtttattacgtgacagtgtacgtaaggttactttccgttcggtaggtacggttcggaccgtaagggaccgaaggtagaactcgacgaacgaacgtggtacggctcgcactacg

SEQ ID NO: 60302 - DNA, 634 bp, Homo sapiens
  misc_feature: GYAE6OF01BJQGV.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagacctatttgtattggtacctgcagaaggcaggccagtctccacatctactatctatgaagtttccagtcgattctcgtggagtgccagtattaggttcaggtggacgaggcgggtcagggcaacgagtaatttcaacaacgtaagaaaactcgacgggtaccgggtgggacggtcgtaggtaggtaagtttagggtttacggggttttaattacgtcgtacgtagttacggtacgttaacgggttttactttttacccggtttacccgggttgggttaacccgggttccgggtaaacccggaaacggggttaaacccggtaaaggggttaagggtaaacttaccgaaaccgtaaccggtaacgttcggtacggtacctacggtaccacccgttaacg

SEQ ID NO: 60303 - DNA, 689 bp, Homo sapiens
  misc_feature: GYAE6OF01B4X6N.17.4.A04.1.454.CMB.1.raw
tcagcgtagactagcacgaccggtgctcgatttagagtagtgatcaggacttctcagttcatcttctcaccatgaggctccctgctcagctccgtggggctgctaatgctctggatccctggatccagtgcggatattgtgatcgacccagactccactctctctcgtccgtccacccgtggacacgcccgcctccatccgtcctgactaagtctagtcagacgcctcctgacagtagtgaagtaggaaacgtaccttagtttgtacgttcggtacctgacgaaggaacgcgacggacctacgtcctaccaactactcctaacctaatcgtattacgtactttcagttcgtacttctgtaggagtcgacagtagtacgttgaggtcgacgacggtcgggtacaggctaacgtagttacttacgaacgtaacgtaaagaacgtcggacgggtcgggtaggacggtagtaggtaaggtacgtttagggttttacgggttaattcgtagtacgttaacgtacggttaacgttaacgtttttccgttttacccggttacgggttacggttaaccccgggttaacggtacccggtaaaaggggtaacccggtaaagggttaacgtaaaccggttaccgaaaccggtaacgtaaccggttgggtaccggacgttaccggaaccttaccggttacg

SEQ ID NO: 60304 - DNA, 572 bp, Homo sapiens
  misc_feature: GYAE6OF01DPIYP.17.4.A04.1.454.CMB.1.raw
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccccgtggacagccggcctccatctcctgcaagtctagtcagacgcctcctgcatagngataggaaaagtaccttatttgtattggtacctgacagagcaggccagtctcantctctaatctatgtaagtttccagtctattctcgtaggacgtcgccgtaaggtagttacgggttcaagggtcgggacagggtccgggtacaggcctaagagtactttacaactacgtaagaaatcgaagggccgggtgggagtcgtaggaggtagttagtttagggtttactcgtagctagtgacgttaaggtttctttcccgtggtacggtaccgttcggaccgaagggtaccgaagggtagaaactcgaaacgtacgaacgttgggtacgcgttagccgtaactacg

SEQ ID NO: 60305 - DNA, 875 bp, Homo sapiens
  misc_feature: GYAE6OF01B1AT6.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaacgtaccttatttgttaactttcgggtaacctgaccgaaggaacggccacgggccacggttcctcccaactacttccttacccttaaatcttaagttacgtaaacgtttttcccaagttaccgtaactttccgttacgtaggggacgttcggacccgtaaggtaagtttacgggtttaccgaaggggttcgggaccgaacgggtcccgggggttacgaaggggtacccgtaacgtaacggttaacgtttttaccgaaccgttaaaccgttaaacggtaaaaacgttccgggtaacggggtaccccggggggttaggggtaacggggtaccgttaggggtaaacgggttaacgttttaaggggtttttacgggggtttttaactttaacggttacggttaccggttaacggttacgggttaaccggtttaaacggggtttttaccgttttttaccccgggttttacccggggttaacgggttaacccggggtttacccgggtaacccgggtaaaaccggggggtaaacccggttaaacgggggttaacgggttaaaaacgttcccggaaaccggtaaaccggttaaaccggttaccgggttacgggtaccgttaccggaacccgtaacccgtttaaccgg

SEQ ID NO: 60306 - DNA, 649 bp, Homo sapiens
  misc_feature: GYAE6OF01ELJT6.17.4.A04.1.454.CMB.1.raw
  modified_base (181)..(181): a, c, t, g, unknown or other
  misc_feature (181)..(181): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacngccgcctccatctcctgacaagtctagtcagacgcctcctgcatagtgataggaaaagtaccttagtttgtattggtacctgcagaaggcaggccagtcctccacatctacctaatctatagtaatttccagtcgtattctcgtggagtgaccagtattagggtcaggtcggctagggcgggtacacgggcaacgagtactttaccaactaactaagaaaacgtcgaacggggtcccggggtagggacgggtcgtaggtaagggtagttttaagggtttacggggttttaacttacgtgtacgagttaggtaccgttaaagggttttacttttacccggttaccggttacgggtaccggttccgggaacccggtaaacggggtaaccgtaaacggggttaaggtaaacgtaccgaacggtaaccggtaaacggttcggtacggtaccgttcggaccgtaaccgttacg

SEQ ID NO: 60307 - DNA, 597 bp, Homo sapiens
  misc_feature: GYAE6OF01D87B6.17.4.A04.1.454.CMB.1.raw
  modified_base (308)..(308): a, c, t, g, unknown or other
  misc_feature (308)..(308): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctctgcatagtgataggaaaagtccttatttgtattggtacctgcagaaggcaggccagtctccacatcctacctaatctatgtaacgtttccngtctattctacgtggatcgacctaagtaagttaggttccaaggttcggacgagggtccgggtacaagggaccaacgtaagtactttacaactaactagtaaaaactcgagggccgggtaggaggtctaggaggtagttaggtttaggggtttattacgtgactagttgtacgtaacggttttcttttccgttacggtacggtaccggttaccgggtaccgaaacgggtaccgtaagggtagtaaacgtcgaacgtaacgaacgtggtacggactcggtaccaccgtacg

SEQ ID NO: 60308 - DNA, 708 bp, Homo sapiens
  misc_feature: GYAE6OF01CX0NX.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagacctccactctctctcgtccgtccacccctggacacgcccggcctccatcctcctgactaagtctagtcagacgccctcctgacatagtagaagtaggaaaacgtaccttattttagtagtttcggtacctgacaaggaacggcaacggccagttcctaccactacttcctacctaatctaatacgtaacgtttccagttcgtatttcctcgtaggtacgtcgacctaaggtacgttaggttccgtaaggtcgggacgtaacggggtccgggtacgacgggtaccaacgtaagtactttacaactaacgtaagtaaaacgtcgaacgggtccggggtagggaacggtcgtagggaacggttagtttagggttttagggtttaacttacggtacgtacgtaagtcgtaacgttaacggttttacctttttcccggttaccgggttacgggttaccggtttaccgggaacccggtaaacgggaaccggtaaacgggtaacggtaaacgtaccgaaacgtaaccgtaacgttcggtacggtacgtacgtaccgtacgtaccg

SEQ ID NO: 60309 - DNA, 671 bp, Homo sapiens
  misc_feature: GYAE6OF01DOIJ6.17.4.A04.1.454.CMB.1.raw
  modified_base (187)..(187): a, c, t, g, unknown or other
  misc_feature (187)..(187): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (319)..(319): a, c, t, g, unknown or other
  misc_feature (319)..(319): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagcgtagactagcacgaccggtgctcgatttagagtagtgatcaggacttctcagttcatcttctcacatgaggctccctgctcagctccgtggggctgctaatgctcgtggactccctggactccagtgcggatattgtgatcgaccagacctccatctctctcgtaccgtccacccgtagacncggcccgcctccatcctcctgacgtaacgtctaagtcagcnccttcgtgactagttagngtagttaagggaaactacttagtttgtaagttcggtacctgacaaggaacggcaggtccctagtcctactaanacgtcctaacttaatcgtatagtaacttccaagttcgtattctacgtggactacgacctagtaggtgtacgnggagcgcggacgggtnacggacaacgtatacttacgaactaacgtaagtaaaacgtcgaggaccgggttaggacggtacgtaggtagtaagtttaggttttacgggtttattagtcgtacgtagtagtaacggttaacgttttcgttttacccgttcgggttaggtaacccgggttcgaaccgggtaaacgggtaaccgggtaaagtaaggggtaaacttaccggaaaccgtaacggtaacggttacggtacgttaccggacggtaaccgtaccgttaac

SEQ ID NO: 60310 - DNA, 661 bp, Homo sapiens
  misc_feature: GYAE6OF01AUV0N.17.4.A04.1.454.CMB.1.raw
  modified_base (287)..(287): a, c, t, g, unknown or other
  misc_feature (287)..(287): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacacgccggcctccatctcctgcaagtctagtcagcgcctcctgcatagtgataggaaagtccttatttgtattcggtacctgacaggaaggcaggccagtcctccacnctcctacctaatctatgtaacgtttccagttcgtatttccgtcgtggacgtgacccgtagtagttacgggttcaggtggactagggccgggtacagggacacgtacgtactttcaactacgtaagaaaactcgaacggccgggtagggaggtcgtaggtagggtaagtttaggtttaggggttttaacttacgtcggtacgtaagttcggtacgtttaaacggtttaccgtttttacccggtttaccgggttacgggtacccggtttaccgggacccggtaaacggggtaaccgtaaacggggttaacggtaaacgtaccgaaaccgtaacggtaaccgttagggtacggtaccgttacgaccgtacccgtacg

SEQ ID NO: 60311 - DNA, 784 bp, Homo sapiens
  misc_feature: GYAE6OF01ENRYQ.17.4.A04.1.454.CMB.1.raw
  modified_base (140)..(140): a, c, t, g, unknown or other
  misc_feature (140)..(140): n is a, c, g, or t
  modified_base (186)..(186): a, c, t, g, unknown or other
  misc_feature (186)..(186): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggattattgngactgaccccagacctccactctctctgtcccgtcacccctggacngcccggctcactctcctgcaagtctaggtcacgcgtccttcctgactacgttaggtacgtaggtaaaggaaaccgtaaccttttagttttagtttaggtttaccggttaaccgtccgacggaaacggacggacgacccggacgtaccgttccctacaacttacctttacccaatttaaccttacttaagtacgttaacgtttccgaaaacgttcggtaacttcgttacgttacggtacgtcggtacgtaaggtaccgttaggtacgttaagggttcgacgtacgggtcgggtacgaacgggtaccaacgtacgttaacttaccgaacgttaacgtaacgtaaaacgtacggaacgggtaccgggtacgggtacgggtcggtaggtaacggttagttaaggtttagggtttaagttacggttagtaacgtagtacgtacgttaacggtttacgttttaccggttaccggtttaccgggttaccggtacgggtaaccggtaaaaccggggtccaaaacgggttccgggaaaaacgttcggaaacctacggtaaccgtaacggtaacgggtaccgttaccgggtaccgttacccgtaaccg

SEQ ID NO: 60312 - DNA, 726 bp, Homo sapiens
  misc_feature: GYAE6OF01EINAS.17.4.A04.1.454.CMB.1.raw
  modified_base (181)..(181): a, c, t, g, unknown or other
  misc_feature (181)..(181): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcgatattgtgatgacccagactccactctctctcgtccgtcacccctggacncgccgcctccatctctgacaagtctagtcagacgccctcctgacagttagtagagtaaggaaacgtacctttatttgttattcggtacctgacgaaggacggcgaggcctacgtcctaccacattcctacctaatcttaagtcgtaacgttttacccagttctatttctacgtgggacttcgactaagtagttacggttcaggtcggacgagggtcggtacgaggactacgagttactttaccaactaacgtaagaaaacgtcgacgggtaccgggtgggaggtcgtagggtacggttaagtttagggttttagggttttaactacgtgtacgtaagttacggttaacgtttaaagggtttttcctttttacccgggttacgggttaccgggttaacccgggtttaccgggaccgggttaaaaccgggttaacccggggttaaaggggttaaagtaaaacccggttcccggttaaaacccgtaacgggttaaaccggtttcggggtacgtacccggtttacgtaccccgttaacgtttaacccgg

SEQ ID NO: 60313 - DNA, 686 bp, Homo sapiens
  misc_feature: GYAE6OF01AX6SJ.17.4.A04.1.454.CMB.1.raw
  modified_base (228)..(228): a, c, t, g, unknown or other
  misc_feature (228)..(228): n is a, c, g, or t
tcagcgtagactagcacgaccggtgctcgatttagagtagtgatcaggacttctcagttcatcttctcaccatgagcctccctgctcagctccgtggggctgctaatgctctggactccctggatccagtgcggatattgtgatcgacccagacctccactctctctcgtcccgtccacccctggaccacggcccggcctccatcctcctgctaagtctagtcagacncctctgctagtagtgataggaaactaccttatttgtaattcggtaacctgacaaggaacggcacggcctagtccaccatactcctactaatctatgtaagtttccagtcgtattctcgtaggacttcgacctaaggtacgttaaggttcgaagggttcggacgtacgggtaccgggtacagggtacaacgtacgttaactttaccgaacctaacgtaacgaaaacgtcgtaacggggtacgggtagggaggtccgtaagggtaacggtagtttaagggttttacggggtttaactttacggtacgtactaggttacggtaacggttaaacggttttaccgttttcccggttacggttacggtacccggttacgggacccgtaaacggggtaccgtaaggggtagaaaccgtacgaacggtaacgtaacgtggtacgtactacggtaccgaccgttacg

SEQ ID NO: 60314 - DNA, 770 bp, Homo sapiens
  misc_feature: GYAE6OF01B8TDG.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatcctggatccagtgcggatattgtgatgacccagactccactctctctcgtccgtccaccccgtggacacgccggcctccactcctcctgacaagtctagtcagacgtcctctgctataggtgagtaggaaaacgtaccttagtttagtagtttacggtacctgacgaaggaacggtccgacggcctacgtcctacccgaactacttacctaccttaatctaagtacgttaacgtttccagtcgttacttctcggtaggtacgtcgaccgtaaggtagttaacggtcgtaaggtcgggtacgacgggtacggggtccaacggggtacctaacgtaaggttaccgtttaaccgaaccgtaacgtaaacggtaaaacttaccgggaacggggtacccgggggttaggacgggtacgttagggaacgggttaagttttaacggggttttaggggttttaaacttacgtcggttaacgtacggtttacggttaacgttaaacgggttttcgttttaccccggttacggggttaaccgggtaccgggttaccggggaccgttaaaacgggggtaaccggttaaaggggtaacggtaaacgtacccgtaacggtaaccggttaaccggttgggtacggaccgttcgaacccgtaaccttacg

SEQ ID NO: 60315 - DNA, 594 bp, Homo sapiens
  misc_feature: GYAE6OF01C7X0B.17.4.A04.1.454.CMB.1.raw
  modified_base (139)..(139): a, c, t, g, unknown or other
  misc_feature (139)..(139): n is a, c, g, or t
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgngatgacccagactccactctctctcgtccgtccacccctggacagccggcctccatcctccngacagtctagtcagacgcctccgtgacatacgtgatggaaagaccttatttgtattcggtacctgcaggaagcaggccagtcnccacnctctactaatctatgtacgttcagtctattctcgtgagtcgacctagtagttacggtcgaggtcggacgacggtcgggtacacgggctaacgtaacggtactttaccgaactaacgtaaggtaaaacgttccgacgggtaccggggtagggtacgtacggtacgaggtaagtttaggtttagggtttacgttagtgtactagtagtacgttagtttactttcgttcgtcggtaccggttacgcggaaaccgggtacgaaggtaggaaatcaaccgtaacgtacggtgtacgcgactccgactacg

SEQ ID NO: 60316 - DNA, 164 bp, Homo sapiens
  misc_feature: GYAE6OF01EEL0K.17.4.A04.1.454.CMB.1.raw
  modified_base (115)..(115): a, c, t, g, unknown or other
  misc_feature (115)..(115): n is a, c, g, or t
  modified_base (157)..(164): a, c, t, g, unknown or other
  misc_feature (157)..(164): n is a, c, g, or t
tcagcgtagactagcacgaccggtgctcgatttagagtagtgatcaggacttctcgagttcatcttctcaccatgaggctccctgctcagctcctggggctgctaatgctctggntcctggatccagtgcgatattgtgatgacccagacctccacnnnnnnnn

SEQ ID NO: 60317 - DNA, 677 bp, Homo sapiens
  misc_feature: GYAE6OF01BLR01.17.4.A04.1.454.CMB.1.raw
  modified_base (452)..(452): a, c, t, g, unknown or other
  misc_feature (452)..(452): n is a, c, g, or t
  modified_base (500)..(500): a, c, t, g, unknown or other
  misc_feature (500)..(500): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctcgtcgtccgtccacccctggaccacgccggcctccatctcctgcaagtctagtcagacgtcctcctgcatagtgagtaggaaacgtaccttatttgtattggtacctggacaaggaaggcacggcctagtccaccaactactactaccctaaatcctaagtacgtaacttttcccaagtccgtaacttctcgtggagtcgaccaaggtatacgggttcagtgggcagggtcgggtcaaggcaacgtacgttattccgaactagaagtaaagtcggacggtccggggaggnggtacgtagggtaaggttatttagggttttagggtttaactttacggngtacgtagttacggtacgttaaagggttttccctttttacccggttcgggttaacgggtacccgggttcggaaaacccgggtaacggggtaaccgtaaacggggttaggtaaaaccgttaccaaccgggtaaacgtaacggttcgggtaccggtattcccggacgtaacccgttacg

SEQ ID NO: 60318 - DNA, 770 bp, Homo sapiens
  misc_feature: GYAE6OF01DBGVU.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatcgacccagacctccactctctctcgtccgtccacccctggaccacgcccggccctccacttcctcctgactaagttctacgtacacgacgtccctcctgactagtagtagtaagtaggaaaactccttatttgtaactttcggtaacctgaccgaaggaaggccgacgggaccagttcctacccaactactccttaccttaaatctaagttaggtaaactttcccgaagttccgtatttccgtcgtgggacgttcgacctaaggtaacgtttcgggttactaacgggttgggacccgtaaggggttcccgggttacgaaacggggccctaaaccggtaacgttaaccgttttaaccgtaaccgtaacgttaaacgtaaaacgtccggtaaacggggtccggggtaacgggacgggtacggtaggtaacgggttagttttaacgggttttaggggttttaacttacggttacgtacgtaagttacggtaacggttaacgggttttacctttttcccggttaccggttacgggttacccggttaccgggaaccggtaacggggtaaccggtaaagggtaacggtaaacgtcgaaccgtaacgtacgtcggttacgcgtacgcctacgtac

SEQ ID NO: 60319 - DNA, 691 bp, Homo sapiens
  misc_feature: GYAE6OF01EPIG0.17.4.A04.1.454.CMB.1.raw
  modified_base (183)..(183): a, c, t, g, unknown or other
  misc_feature (183)..(183): n is a, c, g, or t
tcagcgtagactagcacgaccggtgctcgatttagagtagtgatcaggacttctcagttcatcttctcaccatgaggctccctgctcagctcctggggctgctaatgctctggactccctggatccagtgcggatattgtagatcgacccagactccactctctctgtccgtcaccctggacncgccgcctcatctcctgctaagtctagtcagacgcctcgtgctatagtgataggaaactacttattgtattggtacctgacaaggaggctacgggcctacgtcctaccgtactacttcctaccttaatcttagtacgttaacgtttccagtcgtattcgtgtggacgtcgaccagtagttacggtcaaggtcggcgtaggtcgggtacaggtaccaacgtaggttacttacgaacgtaacgtaaagaaaacgttccggaacggggtccggggtagggtaacggtacggttaacgggtaagggtttaagttttaacgggtttttacggggttttaaacttacggtaggtaccgtaaggttacggtaaccggtttaaacggttttccgtttttacccggtaccgggttacgggttaccggttaccgggaccggtaaacgggtaaccgtaaagggttaacgaaacgtccgaacgtaaccgtaacgtggtacgtcgtacgaccgtacgtacg

SEQ ID NO: 60320 - DNA, 730 bp, Homo sapiens
  misc_feature: GYAE6OF01AWXEI.17.4.A04.1.454.CMB.1.raw
  modified_base (238)..(238): a, c, t, g, unknown or other
  misc_feature (238)..(238): n is a, c, g, or t
tcagcgtagactagcacgaccggtgctcgatttagagtagtgatcaggacttctcagttcatcttctcaccatgaggctccctgctcagctcctggggctgctaatgctctggactccctggatccagtgcggatattgtgatgacccagactccactctctctgtccgtcacccctggacacgcccggcctccatcctcctagctaagtctagtcagacgccctcctgcagttaggnggattaggaaacgtaccttatttgtattcggtacctgacaggaacggcagggtccagtcctcactatcctacctaatcctagttcgtaaacgttttcccagttcgtaactttcctacgtgggtacgtcggtacccgaagttaacggttacgggttacgtacgggttacgggacgtaagggggtccgggttacgaacggggacctaacggtaaggttaacctttaccgtaacctaacgtaacgtaaaacgtcggaacgggtacccggggtagggacgggtcgttagggaacggttaggtttaaggttttaggggttttaacttacgtcggtaactaggttacgtacgttaacggttttcgttttacccggttcccgggttagggttaaccgggttaccgggaacccggtaaacggggtacccggtaagggtaacgggtaactaccgaaaccgtaacggtaacgtcggtacggtacgtcgtaccgtaccgtacg

SEQ ID NO: 60321 - DNA, 693 bp, Homo sapiens
  misc_feature: GYAE6OF01BQEL5.17.4.A04.1.454.CMB.1.raw
  modified_base (227)..(227): a, c, t, g, unknown or other
  misc_feature (227)..(227): n is a, c, g, or t
  modified_base (689)..(689): a, c, t, g, unknown or other
  misc_feature (689)..(689): n is a, c, g, or t
tcagcgtagactagcacgaccggtgctcgatttagagtagtgatcaggacttctcagttcatcttctcaccatgaggctcccctgctcagctcctggggctgctaatgctctggactccctggatccagtgcggattattgtgatcgacccagacctcccacttctctctcgtcccgtccacccctggacacgcccgcctccatcctcctgcaagtctagtcaagcncctcctgcagtagtgaagttacggaaaacgtaccttagttttgtacgtttcggtacctgacgaaggaaggcgaacggccacgtcctacccactagtcccttaaccttaatccttaagtaggtaaccgttttaccaggttcgttactttccgtcggtaggtacgttccggacctaaggtagttaacggttcgagggttcggacgtaaggtcccgggtagaaccggtcgaacggtatacgtttacaaccgtacgtaacgaaacttcgggaaccgggtcggggtacggacgggtacgtaagggaagttaggtttaggttttaggggttttaatacggtcgtactaggtacgttacgttaaggtttcctttccggttaccggttacggtaccggttaccggaaccggtaacgggtaacggtaggtaacggaacgtcaacgtaccgaagtcggtagacgtcgaccgnttcg

SEQ ID NO: 60322 - DNA, 734 bp, Homo sapiens
  misc_feature: GYAE6OF01C4Q17.17.4.A04.1.454.CMB.1.raw
  modified_base (405)..(405): a, c, t, g, unknown or other
  misc_feature (405)..(405): n is a, c, g, or t
  modified_base (462)..(462): a, c, t, g, unknown or other
  misc_feature (462)..(462): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
tcagcgtagactagcacgaccggtgctcgatttagagtagtgatcaggacttctcagttcatcttctcacaatgaggctccctgctcagctccgtggggctgctaatgctcgtggactccctggatccgagtggcggattattgtgatcgacccagacctcctactctctcgtcgtcccgtcccacccgtggaccgaccggcccggaccctacctacttcccttcgacgactaaacggttcctaagtcgaacggcgtccctcgtagctaagtacggagtaaagtaacggtaaacttcgttatttggtaacgttcggacctgaacgaggacggacggaccgtacctagtcctacccattacgtcccttaattaacgtctaagttacgtaacgttccgtacgtactntttccgtacgtgggtaactcgtacgtagtaacgtggttcgagtcgacgtggcggtanacgactgtaatactacagtaatacaagtcggaggtggngagngtagtagttacgttgggttaagttactcgtagtacgtagttacgtaacggtttaacgttttaccggttcggtaacccggttacggggttaaccggttcccgggaaaaccggggtaaacgggttaaacggaaacgggtttaacgggtaaaacctcccgggtaaaaccggttaacggtaccgggtttacggggaacggttacccggaccgttaaccgtaaccggtttaccgg

SEQ ID NO: 60323 - DNA, 642 bp, Homo sapiens
  misc_feature: GYAE6OF01BAU5B.17.4.A04.1.454.CMB.1.raw
  modified_base (306)..(306): a, c, t, g, unknown or other
  misc_feature (306)..(306): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatcgacccagactccactctctctcgtccgtccaccccgtggacacggcccgcctccatcctcctgactaagtctagtcagacgcctctgctatagtagagtaggaaacgtaccttatttgtagttcggtacctgactaaggaacggcacggcctagtcctccacntcctaccttaatctatacgtacgttccagttctacttcgtacgtggagtcgaccagtacgttaggtcaggtcgacgagggtcggtcgacggccagtacgtacttacactaacgtaagaaacgtcggaacgggtccgggtaggaggtcgtaggtagttagtttacggttttagggtttaacttacgtcgtaacgtacgttggtaccgtttaaacggttttcccgttttccggtaccgggttcgggttaccggttaccgggtaccggtaaggtaaccggtaagggtaacggaacgtccaacggtacgtaacgttcggtacgacgttcgacctgtaccg

SEQ ID NO: 60324 - DNA, 721 bp, Homo sapiens
  misc_feature: GYAE6OF01D6YWS.17.4.A04.1.454.CMB.1.raw
  modified_base (114)..(114): a, c, t, g, unknown or other
  misc_feature (114)..(114): n is a, c, g, or t
tcagcgtagactagcacgaccggtgctcgatttagagtagtgatcaggacttctcagttcatcttctcacaatgaggctccctgctcagctcctggggctgctaatgctctggntccctggatccagtgcggatattgtgatgacccagactccactctctctgtccgtcaccctggacacgccggcctccatctctgcaagtctagtcagacgcctcctgacagtagtgataggaaagtaccttatttgtattggtactgcagaggcgaggcagtctcacatctactatctatagtagttccagtcgtattcgtcgtggtagtcgaccgagtagttaggtcgaggtcggccgtaaggtcgggtacgacgggtcaacgtaggttaactttaccgaactaacgttaaacgtaaaacttaccgggacgggtccgggttagggaacgggttaccgtaggggtaaggttaaggttttaacggggttttaggggttttaacgttaccgtaggtaccgttaaggtcgggttaacggttttaaggttttaaccggttttttcccggttaccgggttacggggtacccggttaaccggggtacccggtaaaaacgggggtaacccgttaaacgggggttaacggtaaaacgtacccggtaaccggaaacccgttaaaccgggttcgggttaccggtacccgttacggaaccccgttaacccggttaacg

SEQ ID NO: 60325 - DNA, 655 bp, Homo sapiens
  misc_feature: GYAE6OF01C71A3.17.4.A04.1.454.CMB.1.raw
tcagcgtagactagcacgaccggtgctcgatttagagtagtgatcagggacttctcagttcatcttctcacaatgaggctccctgctcagctcctggggctgctaatgctctggatcctggatccagtgcggatattgtgatgacccagactccactctctctcgtccgtcacccctggacacgccggcctccatctcctgaccaagtctagtcagagcctctgcatagtgactaggaaaatccttagtttgtattcggtacctgacaaggaaggcaggaccagtctccactatctacctaatctaatgtaagtttccaagtcgtattcgtctggacgtcgacctaggtaacttgggttacaaggttggacagggtccgggtacaagggtcaacgtaggtactttacaactaacgtaagtaaaactcgaacggtaccggaagggtacgggacggtacgtagggtaaggttaagtttaacgggttttaggggttttaactttaacggttagtaccgttaagttcggtacgttaaacggtttacttttccggttaccggttacgggtaccggttccgggaccggtaaacggggtaaccgtaaagggtacggtaaacgtaccgaaccgaacggtaacgtggtggacgtcgtcgtaacc

SEQ ID NO: 60326 - DNA, 677 bp, Homo sapiens
  misc_feature: GYAE6OF01BZUIB.17.4.A04.1.454.CMB.1.raw
  modified_base (630)..(630): a, c, t, g, unknown or other
  misc_feature (630)..(630): n is a, c, g, or t
  modified_base (667)..(667): a, c, t, g, unknown or other
  misc_feature (667)..(667): n is a, c, g, or t
tcagcgtagactagcacgaccggtgctcgatttagagtagtgatcaggacttctcagttcatcttctcacaatgaggctccctgctcagctcctggggctgctaatgctctggactcctggatccagtgcggatattgtgatcgaacccagacctccactcctctctcgtcccgtccacccgtggacacggcccggcctccactcctcctagactaagtctagtcaacgtccgcccctgactagtagtagacgtaggtaaacgtacctttaagtttcgtagttcggtaaccgtgacgtaaggacgcgacggcctacgtctaccactactctacctaactctatacgttaacgttctagtcgtacttctcggtacgtacgacgacgtataggttagtacaggtcgacgacggtcggtacgagtcaacgtagtacttacaagtaacgtaagtaaaaccgtggtaaccgggtcggggtaaggacggttaggtaacgtaggttaacgttttagggtttagggtttaactacgtaggacttaggtacgttaacgttacgttttaccgtttccgttaccgggtacggttaccgggttacccggaacggtaacggtaaccgaagggtaacgtaaccncgttaaacgaccgttagtggtaccgtcgtacgacgtnttcggttacc

SEQ ID NO: 60327 - DNA, 733 bp, Homo sapiens
  misc_feature: GYAE6OF01E5ATM.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgacgtatattgtgatcgacccagactccactctctctgtcctcacccgtggacacgccgcctccatctcctgcaagtctagtcagctcctctgactagtagtagagtaacgaaactacgtttatttcgtagttcggtacctggacgaaggaaggtccacggtcacgttccaccactactcttacctaatctaatacgttaacgttcgagttcgtactttcgtagtcggagtcgactaggtacgttaggttcagggtcgacggtacgggcggtacgagtcctaacgtacgtactttacaacgtaacgtaaagtaaacgtaccggtacgggtaccgggtacgggagggtacgtaagggtaacgggttacggtttagggtttttaacgggttttacgtttacgtacgttacgtaacgtttacgggttaacggtttaacgggtttttaccgtttttccccggttaccgggtttaaccgggttaccggttaaccggggtaacccgtaaacggggttaaaccggtaaagggttaaccggtaaacgtaacccggaaacggttaaccggtaaacggttcgggtacgttacggtaccgtaaccgtcccttaacg

SEQ ID NO: 60328 - DNA, 748 bp, Homo sapiens
  misc_feature: GYAE6OF01EX3ET.17.4.A04.1.454.CMB.1.raw
  modified_base (447)..(447): a, c, t, g, unknown or other
  misc_feature (447)..(447): n is a, c, g, or t
tcagcgtagactagcacgaccggtgctcgatttagagtagtgatcaggacttctcagttcatcttctcacaatgaggctccctgctcagctccgtggggctgctaatgctctggactccctggactccaggtgcggtattattgtgatcgacccagacctccactctctcgtcgtcccgtccacccgtggaccacggcccggcccttccactccttcctgactaacgttctacgtcagtaccgtcccttctgactagtagtgagtaggaaacgtccttatttgtagtttacggtacctgacgaaggaacggcgtacggccctagtccctaccgactacttcctaacctaatcgttaagttcggttaacgtttccgagttccgttacttcgtgtacggagttcgacgaggtacgttacgggtacgaggtcggacgagggtcccggtanacggcctaagtacgtactttaccaacgtaacgtaagtaaacgtcggacgggtccgggtagggtacggtacgtaggtaaggttacgtttagggttttacgggtttaactggtacgtagtaacggtacggttaacgtttaacggtttttaccgttttcccgggtttaccggttaccgggtttaccggttaccggtaaaccgggtaaaccgggaaccgggttaaagggtaacggttaaacgttaccggaaaccgtaacggttaacgttccgggtacgttaacccgcgtaacccgtacgttaccg

SEQ ID NO: 60329 - DNA, 917 bp, Homo sapiens
  misc_feature: GYAE6OF01AIO0H.17.4.A04.1.454.CMB.1.raw
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcacaatgaggctccctgctcagctccgtggggctgctaatgctctggactccctggatccgaggtgcgtattattgtgactcgacccagacctccactctctcgtcgtcccgtccacccgtggaccgacggcccggtcctccattccctccgtcgactaacggttctacggtacgacggaccgtcccttccgtcggactagttaaggttanaacggttaaacggaaaaccgttaccgttttagttttaggttaacgtttaccggttaccgtaggaccggtaacggaaccggccgtaccgggtacccgtaccgttaccctaacccgtactacgtttacccttaacctttaacttacgtttaacgttaccggtttaaaccgttttaccgacggtttaccgtaacttttccggtacgtaacgggtacggtacgtaaccgttaagggttacggtttacgggtttacggtacggggttacgggaccggtaacggggtccgggtaaccgacgggtaaccgtaaccgtaactttaccgtttaaccgaaaccgtaaacggtttaaacgaaaaccggttccggggaaccgggggttaccggggtaagggtaacgggttacggttaaagggtaacggttttaacgggttttaggggttttaacgggtttaactttaccgggtcgtaacgttacggttaaccggtttaaccgggtttaaccggtttttccctttaccgggttaccgggttaccgggttaccggttaacggggaacccgggtaaacgggtaacgggtaaacggtaacggaaaccggtcgaacccgtaagtacggtcggttcggacctcggacccgttagtcg

SEQ ID NO: 60330 - DNA, 817 bp, Homo sapiens
  misc_feature: GYAE6OF01C6M6O.17.4.A04.1.454.CMB.1.raw
  modified_base (188)..(188): a, c, t, g, unknown or other
  misc_feature (188)..(188): n is a, c, g, or t
tcagcgtagactagcacgaccggtgctcgatttagagtagtgatcaggacttctcagttcatcttctcaccatgaggctccctgctcagctcctggggctgctaatgctctggactccctggactccgagtgcggtattattgtgatcgacccagactccactctctctcgtccgtccaccctggacncgccgcctcatcctctgactaagtctagtcagacgcctccgtgctataggtagaagtaggaaactcttagtttcgtagttcggtacctgacgaggacggcgacggcctagtccaccactacctaccttacgttaatcttaagttacgttaacgtttccaagttcgtatttccgtgtagggacgttacgacctaaggtagttacgggtctagggtcgggacgtaggggtccggttagaacgtccgaacgtaacgtactttaaccgaacgtaacgtaacgtaaacggtacggtaacggggtccggggtaagggtacgggtacggttaagggtaacgggtttaacggtttttaacgggttttaacggggtttttaactttaacgggttacgttaacgttaacgggtttacggttaaccggttttaaccgggtttttaacccgttttttacccgggttacccgggtttaaccggggttaaccccgggttttaccggggaaacccggggttaaaacggggtaaccccgggttaaaaggggtacggttaaaacccgttaccggaaaacccggttaaccggttaaccggttcggggttaccggtacgtaacccgtaacccgttacccgttaaccgg

SEQ ID NO: 60331 - DNA, 670 bp, Homo sapiens
  misc_feature: GYAE6OF01A8UV7.17.4.A04.1.454.CMB.1.raw
  modified_base (234)..(234): a, c, t, g, unknown or other
  misc_feature (234)..(234): n is a, c, g, or t
tcagcgtagactagcacgaccggtgctcgatttagagtagtgatcagggacttctcagttcatcttctcacaatgaggctccctgctcagctcctggggctgctaatgctcgtggactccctggactccaggtgcggtattattcgtgatcgacccagacctccactctctctcgtccgtcacccgtggacacgcccgcctcatctcctgctaagtcgtagtcagacgcctccngtcagtagcgaagtaggaaacgtcctatttagtattcggtactgacagaacgctacggcctaggtacctccaactcgtaccgtacctaagtctaacttacggtaacgttttcccaagggttcctactttcggtacgttggggtacgttcggacctaggttaacgttcgggttaccaaggttcgggacctaagggtccgggtaccgaaggtaccacgtacgtaactttacaaccgtacgtaaacggtaaactcgaacgggtccgggttaggacggctaggacgtagttaggtttagggttacttacgcgtactacgtacggtacgttaacggtttctttacccggttacggtacgggtacgttaccgggacgtaaacgggtaaccgtaaggttagaacgtcgaacctaggtaacgtcgtacgactcgctaccgtacg

SEQ ID NO: 60332 - DNA, 703 bp, Homo sapiens
  misc_feature: GYAE6OF01BCKDU.17.4.A04.1.454.CMB.1.raw
  modified_base (144)..(144): a, c, t, g, unknown or other
  misc_feature (144)..(144): n is a, c, g, or t
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (403)..(403): a, c, t, g, unknown or other
  misc_feature (403)..(403): n is a, c, g, or t
  modified_base (491)..(491): a, c, t, g, unknown or other
  misc_feature (491)..(491): n is a, c, g, or t
  modified_base (567)..(567): a, c, t, g, unknown or other
  misc_feature (567)..(567): n is a, c, g, or t
  modified_base (690)..(690): a, c, t, g, unknown or other
  misc_feature (690)..(690): n is a, c, g, or t
  modified_base (703)..(703): a, c, t, g, unknown or other
  misc_feature (703)..(703): n is a, c, g, or t
tcagcgtagactagcacgaccggtgctcgatttagagtagtgatcaggacttctcagttcatcttctcacaatgaggctccctgctcagctccgtggggctgctaatgctcgtggactcccgtggactccgagtcggcggattnttggtcgatcgaacccagtacctcctactctctccgtcgtacccgtccacccgtggaccncggccgcctacnctctctagactaagtctacgtacacgccgtccctacgngtactaagtaggtagtaaggtaacggaaaccttacttttgtttaggttagttaccggtactgaacggaggtaacggcgaacggcctatccaccaacttctccttaactaagtcgttagttacgtacttccggtattcgtacgtttccgngtagggtacgtacgtacgtaggttaaccgttagttggacggtaggcggttcgggacgggttcaacgggtcctaagttacgtaccttanaaccgtattaaacccggaaagtcgggaacgggtcgggtaagcgtaagtagggtattacggttaggtttacgggttntagggttacaggtagttacgggttaacgtttaccgtttacctttcgggacctacggggtccctaggggtaccctaaaacgggtcgaaacggttacgactacgaacgtaccgtgtggaaccgtnactagaccgtttn

SEQ ID NO: 60333 - DNA, 615 bp, Homo sapiens
  misc_feature: GYAE6OF01A8EGT.17.4.A04.1.454.CMB.1.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
  modified_base (419)..(419): a, c, t, g, unknown or other
  misc_feature (419)..(419): n is a, c, g, or t
  modified_base (458)..(458): a, c, t, g, unknown or other
  misc_feature (458)..(458): n is a, c, g, or t
  modified_base (605)..(605): a, c, t, g, unknown or other
  misc_feature (605)..(605): n is a, c, g, or t
tcagcgtagactagcacgaccggtgctcgatttagagtagtgatcaggacttctcagttcatcttctcaccatgaggctccctgctcagctcctggggctgctaatgctctggactccctggatccagtgcgatattgtgatcgacccagacctccacttctctctcgtcccgtaccaccccgtggacctacgcccgcctcatcctacctgactaagtctagtcaagcgccctctgctatagtgagtagaaactcttatttgtacttgactgacgagagcacgcgtatcnccacntccacttatntatgtacttcagtctattcgngnggagtcacgtagtgtagtcgaggtgacngggcggtcagcagtacgttatcgaactagtaaacgaacgttcggaagggtcggtagaaccggngtagtagggttatttacgggttttagggtaactttcggngtacgtacgtacggtacgtttagttttcccttttaccggtacggtcggtaccggtaccggaacgggaaaccggttaccgtaaagggtcccgtaaaactccggtaaaccgtactaaacgggtttcgaacccgggtataccccggtaanccccgtttag

SEQ ID NO: 60334 - DNA, 570 bp, Homo sapiens
  misc_feature: GYAE6OF02HMDBU.17.4.A04.1.454.CMB.1.raw
  modified_base (163)..(163): a, c, t, g, unknown or other
  misc_feature (163)..(163): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
tcagcgtagactagcacgaccggtgctcgatttagagtagtgatcaggacttctcagttcatcttctcaccatgaggctccctgctcgagctcctggggctgctaatgtcgtcgtggatcctggatcccagtgcggatattgtgatgacccagactccactcnctctgtccgcaccctggacagccgtctcatctcctgcaaagtctagcagagcctctgcaattgtgatggaaacactatttggattcggtacctgcagaaggcaggccagttccncantctctaatctangtactttcagtcattctgtaggagtgccagtataggttcagtggcaggcgggtacaggcactagtactttcactacgtagaaaatcgaggtcgggtggaggcgtagagtagttagtttaggtttagtttacgttagtacgtagtagtacgtaagttacgttttaccgtttaccgttacggttacggttacggtaccggtaacggtaaccggtaacggtaacggtaacggtaacgtaacgtaacgtaacgtacgtacgtacgtacgtacgtaccgtacg

SEQ ID NO: 60335 - DNA, 557 bp, Homo sapiens
  misc_feature: GYAE6OF02HTQ6Y.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagacctatttgtattggtacctgcagaaggcaggccagtctccacatctcctaatctatgtaagtttccagtcgattctctggagtgccagataggttcagtgcaggcgggtcaggcacagtatttacacactagaaaatcgagccgggtaggaggcgtagaggtagtagtttaggggttattacgtgtactagtgtacgtaaggttactttttcccgttccggttaggtaccggtttacgggaccgtaacgggaccgtaaagggtacggtaaacgtaccgtaaccgaacgtaacgtggtacggtcgtacgaccaccgtacg

SEQ ID NO: 60336 - DNA, 533 bp, Homo sapiens
  misc_feature: GYAE6OF02IAMN2.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcaccctggacagccggcctccatctcctgcaagtctagtcagagcctctgcatagtgatggaaagacctattgtattggtacctgcagaaggcaggccagtctccacatctcctaatctatgaagtttcagtcgattctctggagtgccagataggtcagtgcaggcgggtcaggcacagtactttcacactagaaatcgagcgggtggaggcgtgaggtattagttgggtttattacgtgactatgtacgtaaggttacttttccgttccggtggtaccgttacggaccgtaacgggtaccgtaagggtacggaaacgtaccgtaaccgacggtaacgtggtacggtacgtcgacctactacg

SEQ ID NO: 60337 - DNA, 610 bp, Homo sapiens
  misc_feature: GYAE6OF02H0BNB.17.4.A04.1.454.CMB.1.raw
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
  modified_base (391)..(391): a, c, t, g, unknown or other
  misc_feature (391)..(391): n is a, c, g, or t
tcagcgtagactagcacgaccggtgctcgatttagagtagtgatcaggacttctcagttcatcttctcacaatgaggctccctgctcagctcctggggctgctaatgctctggatcctggatccagtgcggatattgtgatgacccagactccactctctctgtccgtcacccctggaccagcccggcctccatctcctgcaagtctagcagactccctcctgctataggtcgataggaaanacctatttgtatggtactgcagagcagcctagtctccanatctacctaaatctttagagtaagttttccaggttcattctctgggatgccagtataggttacagtgcgaagcgggtcagggcacgagtatttacgactaatagtaaaancgaagccgggtaggaacgcgtagaggtattacggtttgggtttaattacgtaggtacagtagtactaagggtttacttttttcccggtacgttacggggtaaccgtttcgggtacccgaaacggggtttaacccgaaacgggttaagggttaaacgaacgtttaaccgaacgggttaaaccctagggttacggaacggttcggaaccttaccctaacgg

SEQ ID NO: 60338 - DNA, 545 bp, Homo sapiens
  misc_feature: GYAE6OF02G3TGK.17.4.A04.1.454.CMB.1.raw
  modified_base (235)..(235): a, c, t, g, unknown or other
  misc_feature (235)..(235): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcaccctggacagccggcctccatctcctgcaagtctagtcagagcctctgacatagtgatggaaancctattgattggacctgcagaagcaggccagtctccacatctacctaatctatgtaagtttccaagttccgatttctacttgggaagttcgccaagtataaggttcaaggttcggcaggcgggtcagggcacagatttcacactagaaaatcagccgggtaggaggctgaggattagttgggtttattacgtagactagtgtctaaggtttagttttacccgttcggtacggtacgttcggaccgaaggtaaccgaagggtacggtaaatacgaaccgtaacgtaacgtcggtagtctcgtaccactacg

SEQ ID NO: 60339 - DNA, 526 bp, Homo sapiens
  misc_feature: GYAE6OF02JI8IP.17.4.A04.1.454.CMB.1.raw
  modified_base (311)..(311): a, c, t, g, unknown or other
  misc_feature (311)..(311): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctatttgtattggtacctgcagaaggcaggccagtctccacatctcctaatctatgaagtttccagtcgattcnctggagtgccagataggttcagtggcagcgggtcaggcacagtactttcacactagaaaatcgaggcccgggtggaggctggaggattagttgggtttattacgtgcagtgactaaggttacttttccgttaccggtggtacgttcggaccgtaagggaccgtaagggtacggaataccgacaacgtacgtggtacggtctacggacaccgtacg

SEQ ID NO: 60340 - DNA, 561 bp, Homo sapiens
  misc_feature: GYAE6OF02JVBQ6.17.4.A04.1.454.CMB.1.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctatttgtattggtacctgacagaagcaggccagtctccacatcctcctaatctatgaagtttccagtcgattcnctggatgccagtataggtcagtgcaggcggtcaggcacgagtatttcacacgtagaaaactcgaacggccgggtaggacggtcgtaggaacggtattaacggtttgggttttaacgttacgtacggtacagttcgacgtaacggtttaacttttccgttaccgtggttaacgttccggacgtaacggtaccggtaacggtaggtaaactccgtaacgaacgtacgtcggtaggcgtacgacgactacg

SEQ ID NO: 60341 - DNA, 534 bp, Homo sapiens
  misc_feature: GYAE6OF02H0P7Z.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggatgccagtataggttcaggtgcaggtcgggtcaggcacgagtatttcactatagaaaatcgaggccgggtaggaggcgtaggaggtagttagttagggtttattacgtgactagtgtacgtaagttacttttccgttcgtggtacgttccggaccgtaagggaccgaaggtagaacgtaccgaacgaacgtacgtacggtggtacgtcgacacgtacg

SEQ ID NO: 60342 - DNA, 583 bp, Homo sapiens
  misc_feature: GYAE6OF02J1KUQ.17.4.A04.1.454.CMB.1.raw
  modified_base (326)..(326): a, c, t, g, unknown or other
  misc_feature (326)..(326): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggaccagccggcctccatctcctgacaagtctagtcagacgcctcctgcatagtgataggaaacaccttattgtattggtacctgcaggaaggcagggccagtctccacacttctcctaatctatagtaacgtttccagttcgatttccncttgggacgtgccctaaggtattacggttacaggttcggcacgggtcgggtcaggcacgagtacttcgacgactagaaaactcgacggccgggtaggaggtcgtagaggtacgtaggtttagggttagttacgtgacgtagtagtacgtaaggtttactttccgttccggtaggtaccggttccgggtaccgaacggtaacggaaggtaaggaaactcgtaacgtacggtaacgtcgtacggcgtcggactactacg

SEQ ID NO: 60343 - DNA, 558 bp, Homo sapiens
  misc_feature: GYAE6OF02INWFR.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagccctcctgcatagtgatggaaagcctatttgtattggtacctgcagaaggcaggccagtctccacatctcctaatctatgaagtttccagtcgtattctcgtggagtgccagatggttcagtgcaggcggtcaggcacagtattacacactagaaatcgaggccgggtaggaggctaggaggtagttagtttggggtttattacgtgtacgtagtgtacgtaagggtttacttttaccggttaccggttagggtaccggtttcgggaccgtaacgggtacccgtaagggttacggaaacttccgaacgtaacgtacgttggtacggtacgtcgtaccacctacg

SEQ ID NO: 60344 - DNA, 506 bp, Homo sapiens
  misc_feature: GYAE6OF02GGGFP.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggatgccagataggttcagtgcaggcgggtcaggcacagtatttcacactagaaaatcgagccgggtggaggctaggaggattagttgggtttattacgtgacagtgactaagttacttttccgttcgtggtacgttcggaccgaaggaccgaaggtaggaaatcgacgacgaacgtgtaggctgcactacg

SEQ ID NO: 60345 - DNA, 658 bp, Homo sapiens
  misc_feature: GYAE6OF02GEZT9.17.4.A04.1.454.CMB.1.raw
  modified_base (231)..(231): a, c, t, g, unknown or other
  misc_feature (231)..(231): n is a, c, g, or t
  modified_base (647)..(647): a, c, t, g, unknown or other
  misc_feature (647)..(647): n is a, c, g, or t
tcagcgtagactagcacgaccggtgctcgatttagagtagtgatcaggacttctcagttcatcttctcaccatgaggctcctgctcagctcctgggctgctaatgctctggatccctggatccagtgcggatattgtgatgacccagactccatctctcgtgtccgtacacccctggacacgccggcctccatcctcctagcaagtctagtcagacgcctcctgacatagngataggaaagacctattgtattggtacctgcaggaagcgagccagtctaccgacactctacctaatccgtaattgtaaacgttttcccaggttcaattttccacgttagggacgttcgcccttaaaggtagtttaagggtttccaagggttcgccgtaacgggtcggggttccaagggccaacgtaagtaacttttccgaacgtacgtaaggtaaaaactcgaacggtccgggtagggtaacgcgtaagggtaagggtactttaggtttagggggttttaattaaccgttgacgtaacgtaggtaccgttaaaggttttcgtttaccgttacggttacgggacggttaccggtacgaaaccgggtaccgtaagggttacggaaatccgtaacgaacgtaagtcgtagggtcgtacncggtactaacg

SEQ ID NO: 60346 - DNA, 522 bp, Homo sapiens
  misc_feature: GYAE6OF02FZFX0.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggagtgccagataggttcagtgcaggcggtcaggcacagtatttcacactagaaaatcgaggccgggtggaggctggaggtatagttgggtttattacgtgctagtgacgtaaggttacttttcccgttcggttggtacgttcggaccgtaagggaccgtaagggtaggaaactcgaacgacgaacgtggtacggcgtcgacactacg

SEQ ID NO: 60347 - DNA, 582 bp, Homo sapiens
  misc_feature: GYAE6OF02JYQU4.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaacgtcctatttgtattcggtacctgacaggaaggcaggcccagtcctccacatctcctaatctatgtaatttccagtcgattctcgtggagttgcctagtacgttaggttcaggttggacgtaggccgggtacagggcctacgagtactttacaacctacgtaagaaaacgtcgacgggaccgggtggaacggtcgtagggaaggtagtttaggttggggtttaattactggactagtgtacgttaggtttctttccgttcggtgtaccggtcggaccgtaagggacgtaacgggtagtaacgtacgaacgtaacgtaacgttcggtacggctacgaccgtactacg

SEQ ID NO: 60348 - DNA, 520 bp, Homo sapiens
  misc_feature: GYAE6OF02JGE3J.17.4.A04.1.454.CMB.1.raw
  modified_base (237)..(237): a, c, t, g, unknown or other
  misc_feature (237)..(237): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaancctatttgattggtactgcagaaggcaggccagtctccacatctcctaatctatgaagtttccagtcgattctctggatgccagattaggttcagtggcaggtcggtcaggcacgagtatttcacactagaaatcgagccgggtggaggcgtaggaggtagttagttgggtttattactgctagtgacgtaaggttcttttccgtcggttgtacgttccggacgaacgggaccgtaaggtacggaactcgaacgtacgtaacgtgtacggctcgaccactacg

SEQ ID NO: 60349 - DNA, 578 bp, Homo sapiens
  misc_feature: GYAE6OF02HTOWI.17.4.A04.1.454.CMB.1.raw
  modified_base (285)..(285): a, c, t, g, unknown or other
  misc_feature (285)..(285): n is a, c, g, or t
  modified_base (354)..(354): a, c, t, g, unknown or other
  misc_feature (354)..(354): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcaccctggacagcccggcctccatctcctgcaagtctagtcagacgcctcctgacatagtgataggaaagtaccttattgtattggtacctgacagaaggcaggccagtctccacntctacctaatctatgtaagtttccagtcgattctcgtggatgaccagtataggtcagtggcaggcggtnaggcacgagtatttcacacgtagaaatcgaggcgggtaggaggcgtaggaggtagttagtttaggggtttaattacgtgactagtgacgtaaggtttacttttccgttcggttacgggtaccggttacgggaccggtaacggggtaacccggtaagggttaacggaaacgtaccgtaacgtaacggtaacggttcggtacggtcgttacggacctaccgtaacg

SEQ ID NO: 60350 - DNA, 549 bp, Homo sapiens
  misc_feature: GYAE6OF02FTZLV.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgtaagtttccagttcgattctctggagtgccagataggttcagtggcaggcggtcaggcacgagatttcacactagaaatcgagccgggtggaggcgtgaggatagttgggtttaattacgtgtcagtcgacgtaaggtttacttttccgttccggttggtaccggttccggaccgtaacggggtacccgtaaagggtacggaaacgtacgaaccgaacggtaacgttcggtacgggaccgtaggacccacctacg

SEQ ID NO: 60351 - DNA, 541 bp, Homo sapiens
  misc_feature: GYAE6OF02HHCPH.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaagacctatttgtattggtacctgcagaaggcaggccagtctccacatctcctaatctatgaagtttccagtcgattctctggagtgccagataggttcagtggcaggcggtcaggcacagatttcacactagaaaatcgaggccgggtggaggcgtggaggtattagtttaggggtttattacgtgtactagtgtacgtaaggttactttttccgttccggttggtacggtttccggaccgtaacgggtaccgtaagggtcggaaagtccgaacgaacgtacgtcggtggcgtacgaccacgtacg

SEQ ID NO: 60352 - DNA, 570 bp, Homo sapiens
  misc_feature: GYAE6OF02IBL9D.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggctccatctcctgcaagtctagtcagacgcctcctgcatagtgataggaaagaccttatttgtattggtacctgcagaaggcaggccagtctcacatctcctaatctatgaagtttccagtcgtattctcgtggatgaccagtagttaggttcaggtggcagggtcgggtacaggcacgagtatttcacactaagaaatcgaggccgggtaggaggcgtaggaggtagttaggtttaggggtttaattacgtgtactagtaggtacgttaaggtttacttttccgttccggttacggtacgttcggaccgtaacgggtacgtaagggttacggaaactaccgaacgtaccggtaacgtacggtcggtacgtcgtaccgtactacg

SEQ ID NO: 60353 - DNA, 582 bp, Homo sapiens
  misc_feature: GYAE6OF02HTX5V.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagaccttatttgtattggtacctgcagaaggcaggccagtctccacatctctaatctatgtaagtttccagtcgattctctggagtgccagtataggttcagtggacaggcgggtcaggcacgagtatttcacactagaaaatcgaggccgggtaggaggcgtagaaggtaagttaggtttaggggttttaattacgttgacgtagtagtacgtaaggtttactttttcccgttccggttacgggtacggtttaccgggtaccgtaaggggtaacccgtaaagggttacggtaaacgtaccgaaccgtaacggtaacgttgggtacggactacggcctaccgtaacg

SEQ ID NO: 60354 - DNA, 597 bp, Homo sapiens
  misc_feature: GYAE6OF02GSARM.17.4.A04.1.454.CMB.1.raw
  modified_base (314)..(314): a, c, t, g, unknown or other
  misc_feature (314)..(314): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctatttgtattggtacctgcagaaggcaggccagtctccacatcctcctaatctatgaagtttccagtcgattcctntggagtcgaccagtagttacggttcaggtggacagggtcgggtacagggcaacgagttatttccaactacgtaagaaaactcgacgggtccggggtaggacggtcgtagggaggtattagggtttagggttttaattacgtgacgtagtcggtacgtaaggttttacttttcccgttacggtagggttacccggttacggaccgtaacgggtaccgtaagggtaacggtaaactccgaaccgtaacgtaacgttcggtacgtacgtaggaccctaaccgtacg

SEQ ID NO: 60355 - DNA, 587 bp, Homo sapiens
  misc_feature: GYAE6OF02F3EUL.17.4.A04.1.454.CMB.1.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagagcctcctgcatagngatggaaancctatttgtattggtacctgacagaaggcaggccagtcctcactatctcctaatctatagtaacgtttccaggtctatttctcgtggagtgccaaggtagttaggttcaagggttggccgtaggccggggttacaagggccgaacgtagtatttaccgaactaactagaaaagtacgacggaccgggtagggaggtcgtaggaggtagtagttagggtttattacgtagatagtgtacgtaacgttacttttccgttcggttacggtacgttccggtacgaacgggtaaccgtaaggtacggtaaacgtaccgtaacgtaaccgtacgtcggtacggtcgtacgacacgtacg

SEQ ID NO: 60356 - DNA, 661 bp, Homo sapiens
  misc_feature: GYAE6OF02H2OHP.17.4.A04.1.454.CMB.1.raw
  modified_base (180)..(180): a, c, t, g, unknown or other
  misc_feature (180)..(180): n is a, c, g, or t
tcagcgtagactagcacgaccggtgctcgatttagagtagtgatcaggacttctcagttcatcttctcacaatgaggctccctgctcagctcctggggctgctaatgctctggatcctggatccagtgcggatattgtgatgacccagactccactctctctgtccgtcacccctggacngccggcctccatctcctgcaagtctagtcagacgcctcctgcatagtgataggaaagaccttatttgtattggtacctgcagaaggcaggccagtcctccacatctacctaatctatgaagtttccagtcgattcgtcgtggagtcgccagtagttaggttcaggttggcgaggtccggggtacagggccacgtaacgtacttttaccgaactaaccgtaagaaaacgtcgacgggtccggggtagggacggtcgtaggaagggtagtttaggtttaggggttttaacttacgttggtactagttagtacgttaagggttttactttttacccggttccggttacgggttaccggttaccgggtaccggtaaacggggtaaccggtaaaggggttaacggtaaacgttaccgtaaaccgtaaccggttaaaccggttcgggttaccggtaccgttaacggtacccgtaacccgttaaccgg

SEQ ID NO: 60357 - DNA, 528 bp, Homo sapiens
  misc_feature: GYAE6OF02JDVD5.17.4.A04.1.454.CMB.1.raw
  modified_base (313)..(313): a, c, t, g, unknown or other
  misc_feature (313)..(313): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagaccttatttgtattggtacctgcagaaggcaggccagtctccacatctacctaatctatgaagttccagtcgattcnctggagtgccagactaggttcaggtgcgaggcgggtcagggcacgagtatttcacactagaaaatcgacggcgggtggaggctaggaggagttagtttgggtttattactgtacagttgacgtaaggtttacttttccgttcgtcggtacgttcggacgaacgggaccgtaagggtaggaactacgacaaccgacgtggtcgcgtcgacacgtac

SEQ ID NO: 60358 - DNA, 717 bp, Homo sapiens
  misc_feature: GYAE6OF02IRC7H.17.4.A04.1.454.CMB.1.raw
  modified_base (222)..(222): a, c, t, g, unknown or other
  misc_feature (222)..(222): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatcgacccagactccactctctctgtccgtcacccctggacagccggcctccatctcctgcaagtctagtcagacgcctccngacatagtgataggaaacgtaccttatttgtattggtacctgcaaggaaggcacggctagtcctcacatctacctaatctatgtaactttccagtcgatttcncgtggatcgctaagtgtagtcagtgcgaggtccgggtanacggtcaacgtagtacttacaactaacgtaacgtaaaacgtcggaacgggtccggggtacgggaacgggttaccggtaagggttaagggttaacgtttaagggttttacggggttttaaacgttacgttacggtaaccgttacggtacgtaaccggttaacgggtttttaccgtttttaaccccggttaccgggtttaaccgggttaacccgggtttacccgggtaacccgggttaaacggggtaaaccggttaaacggggttaaccgggtaaacgttaaaccggtaacccggtaaacggtaaccggtttacgggtaccggttacggtaccgttaccggaaccgtttaaccgg

SEQ ID NO: 60359 - DNA, 572 bp, Homo sapiens
  misc_feature: GYAE6OF02FY8JG.17.4.A04.1.454.CMB.1.raw
  modified_base (353)..(353): a, c, t, g, unknown or other
  misc_feature (353)..(353): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaagaccttatttgtattggtacctgcagaaggcaggccagtctccacatctctaatctatgaagtttccagtcgattctgtggagtgaccagagttaggttcaggtggacaggcgggtnagggcacgagatttcactactagaaaatcgacggccgggtaggaggtctaggaggtagttagtttaggggttttattacgtcgtacgtagtagtacgtaaggtttactttttccgtccggttacgggtacgttccgggaccgtaacgggtaccgtaaagggtacggtaaacgtaccgtaccgaacggtaacgtcggtacggtcgtcggacctacgtacg

SEQ ID NO: 60360 - DNA, 538 bp, Homo sapiens
  misc_feature: GYAE6OF02HQKC4.17.4.A04.1.454.CMB.1.raw
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaagcctattgtattggtacctgcagaaggcaggccagtctccanatctcctaatctatgaatttccagtcgattctctggatgccagattaggtcagtgcaggcggtnaggcacagtatttacgaacacgtagaaaactcgaggccgggtggaggcgtagaggtagttagttaggggtttattacgtgtactagtgtacgtaagttacttttccgttacggttcggtacgttccggacgtaacgggtaccgaaggttacggaacgtacgtaacgacgtaacgtggtacggctcgtccaccgtac

SEQ ID NO: 60361 - DNA, 558 bp, Homo sapiens
  misc_feature: GYAE6OF02HXAUA.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctattgtatggtacctgcagaagcaggccagtctcacatctacctaatctatgtaagtttccagtcgtattctcgtggagtcgccagtatacggttcagtggcagggcgggtcaggcacagtatttacactactagaaatcgacggcgggtaggaggcgtggaggtagttagtttaggggtttattacgtgactagtagtacgtaaggtttacttttccgttccggtacggttacggttcggtaccgtaacgggtaaccgtaagggtaagaaacgtacgaaccgtaacggtaacgtggtcggacgtacgacctaccgtac

SEQ ID NO: 60362 - DNA, 775 bp, Homo sapiens
  misc_feature: GYAE6OF02HKJIF.17.4.A04.1.454.CMB.1.raw
tcagcgtagactagcacgaccggtgctcgatttagagtagtgatcaggacttctcagttcatcttctcaccatgagactccctgctcagctcctggggctgctaatgctctggatccctggatccagtgcggatattgtgatgacccagacctccactctctctcgtcccgtcaccccgtggacacgcccggcctccatcctcctgaccaagtctagtcagacgcctcctgcatagtgataggaaagtaccttatttgtattggtacctgacaagaacggcacggacctagtcctcacatcctacctatctatagtaacgtttccagtcgtacttcgtctgggtaactcgacctaaggtacgttaacggttcgaaggttcggacgtagggtccggggttacgacgggtacctaacgaacgttaacttttacccaacgttaaacgttaaaggtaaaaacgttccgggtaaacggggtcccgggggttaggggaaaccgggttcggttaacgggtaagggttaagttttaacggggtttttacgggggttttaaacttttaacggttacggttacggtaacggtttaggtaaccggtttaaacgggtttttacttttttaccccgggtttacccggtttacgggtttacccgggttaccgggtaacccggttaaacggggtaacccggttaaagggttaaccgggtaaaacgttaccgtaaccggtaaaccgtaacggttaccgggtacggtaccgtaccgtaccgaaccgttaccg

SEQ ID NO: 60363 - DNA, 674 bp, Homo sapiens
  misc_feature: GYAE6OF02JB04R.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtcccgtcacccctggacagccggcctccatctcctgctaagtctagtcagacgcctcctgcatagtgagtaggaaagtaccttagtttgtatttcggtacctgcgtaagaaggcacggcctagtcctacccacactcctaccttaatcctaattagtaaacgttttccaagttcgtattcctcgtggagttcgacctagtagttaggttcaggtggacgtaggcgggtacacggcgaactagtaactttcaactactaagaaaactcgtaacgggtcccgggtaggtacgggtcgtagggtaaggtagttaagggtttaggggtttaacttacgttacgtacgtaagtcgtaacggttaaacggtttacgtttttaccggttccggttacgggttaccggttaccgggtacccggaaacggggtaaccggaaggggttacggtaaaccgtaaccgtaaccgtaaacggtaacggttcggtaacgggtaccgtacgaccgtaacccgtacg

SEQ ID NO: 60364 - DNA, 527 bp, Homo sapiens
  misc_feature: GYAE6OF02FF8ST.17.4.A04.1.454.CMB.1.raw
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (353)..(353): a, c, t, g, unknown or other
  misc_feature (353)..(353): n is a, c, g, or t
tcagcgtagactagcacgaccggtgctcgatttagagtagtgatcaggacttctcgagttcattcttctcacaatgaggctccctgctcagctcctggggctgctaatgctctggatccctggatccagtgcggatagttgtgatgacccagactccactctctctgtcccgtcaccccgtggacagccggcctccatcctcctgcaagtctagtcagagcctcctgcatagtgatggaaagtccttattttgatttggtacctgcagaggcaggcagtcncanatctctaatctatgaatttccagtcattctctggactcgaccagattaggttcagtggcaggcgggtanaggcacagattcacactagaaactcgaggccgggtggaggtcgtagaggtagtacgtttagggtttattacgtgtactagtgacgtaaggttactttccgttcggtggtacgttcggaccgacggacgtaaggtaggaaacgtcgacgacgtaacgtcggtagtctcgcactac

SEQ ID NO: 60365 - DNA, 738 bp, Homo sapiens
  misc_feature: GYAE6OF02I69SK.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgacaagtctagtcagacgcctcctgcatagtgataggaaaacgtaccttatttgtatttcggtaaccttggacaaggaaggcacgggacccagttcctccaactactcctaccttaatcttaagtacgtaactttccgagtcgtatttccgtcgttagggattcgacctaaggtacgttaaggggtttccaagggttcgggacggtaacgggtccggggttacgacgggtaccgtaacgtaacggttaacttttaccgaaaccgttaacctaaacgggtaaaaacgtaccgggtaagggtacccgggggtagggacgggttaccgtagggaaaggttagtttaacgggttttaggggtttaactttaacgtagtacctagttacggtacggttaaacggttttcttttcccgtttccgggttaggttaacccggtttcgggaccgtaacggggtaaccgtaaagggggttacgtaaacgtacccgtaaacggtaacgttacggttacggacgggtaccgtacggtacccgaccgttacgg

SEQ ID NO: 60366 - DNA, 758 bp, Homo sapiens
  misc_feature: GYAE6OF02GDPA8.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcagtctacgtcagacgcctcctgcatagtgataggaaagaccgtatttagtattcggtacctgctaggaacggcacggccagtcctccactactcctacctaatctatgtaacgtttccagtcgtacttctcgtggtagtcgccagtacgtacggttcgaggtggcgagggtcgggtacgacggacctacgagtactttacaactaacgtaagtaaaacgtccggaacgggtacccgggggtagggaacgggtcgtaacgggtaagggttaaggtttaacgggttttagggggtttttaaacttaccgggttagtaccgttaaggttaccggtaacgggtttaaagggtttttacccgttttttacccggtttacccgggttaacggggttaaccccgggttttaccggggtaaccccgggtaaaacgggggttaaccccgggttaaacgggggttaaaccgggttaaaaccgttacccggtaaaccggttaaccccgggtaaacggtttacgggttaaccgggtaccgttaaccggtacccgtaacccgtttaaccggg

SEQ ID NO: 60367 - DNA, 578 bp, Homo sapiens
  misc_feature: GYAE6OF02G5LAM.17.4.A04.1.454.CMB.1.raw
  modified_base (282)..(282): a, c, t, g, unknown or other
  misc_feature (282)..(282): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgacctcatctcctgcaagtctagtcagagcctcctgctatagtgatggaaacgaccttatttgtattcggtacctgcagaaggcaggccagtctccanactctcctaatctagtcgaagtttccagttccgattctcgtggagtcgaccaggtacttaggttcaagttcggcagggtccggtcagggtcacgtagtactttacgaactacgtacgaaaatcgacggtaccggggtaggaggcgtagtaggtattagttgggtttagttacgtgacgtagtgtacgtaaggtttcttttaccgttccggttcggtacgtttcggccgtaacgggacccgtaagggtacggtaaatcgtaacgacggtacgtcggtaggtctacgtacaccgtacg

SEQ ID NO: 60368 - DNA, 627 bp, Homo sapiens
  misc_feature: GYAE6OF02G85JO.17.4.A04.1.454.CMB.1.raw
  modified_base (237)..(237): a, c, t, g, unknown or other
  misc_feature (237)..(237): n is a, c, g, or t
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgatggaaanacctatttgtattggtacctgacagaaggcaggccagtctccanactctacctaatctatagtaacgtttccagtcattctacgttggagtgccagtagtacggttcaggtcggcaggcgggtcaggccacgtagtactttcaactactaagaaactcgacggtccgggtaggaggtctaggtacggtaattagggtttaggggttttaacttacgtgtacgtagtacggtacgttaaacggtttacgtttttacccgttaccgggttacgggttaccgggttaccgggacccgtaaacggggtaacccgtaaaaggggtttaacggaaaacttcccgaaccgtaaccggtaacgttcggtaccggtacgtacgacccgtaacctaacgg

SEQ ID NO: 60369 - DNA, 732 bp, Homo sapiens
  misc_feature: GYAE6OF02F783X.17.4.A04.1.454.CMB.1.raw
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggggctgctaatcgctctggacttccctggacttccagtgcggatattggtgactcgacccgagaccgtccacgtctacgtcgtcgtccgtaccgacccgtggaccacggcccgcccttccattcctcctgactaacggttcctagccgaagcgtccctcgtgactatagtagatagggaaanaccttagtttagtattcggtacctgacgaaggaacggcgagggcctagtccacctaactactcctaacctaagttccgtagtacggttaactttaccgacgttacgttattccgttacgtagggacgttacgacctaaggtgtacgggttacagggttcgacggtacggggcggttacacgggtacaacgtagtacttacaacgtaacgttaagaaacgtcggagggtaccgggagggtacggtcgagggtaggttagttaggtttacgggttattccgtagtaacgtgtacgtacggtttaacgttttcggtttaccgttacgggttacggtaccgggttaaccgggtacgggttaacggaaacggggttacggtaaaccggtaaaccgttacgtaacccggtaaccgggttaacgttacgggaccgttacgtacccgaaccgtcgttacccgg

SEQ ID NO: 60370 - DNA, 633 bp, Homo sapiens
  misc_feature: GYAE6OF02JQAJC.17.4.A04.1.454.CMB.1.raw
  modified_base (384)..(384): a, c, t, g, unknown or other
  misc_feature (384)..(384): n is a, c, g, or t
tcagcgtagactagcacgaccggtgctcgatttagagtagtgatcaggacttctcagttcatcttctcaccatgaggctccctgctcagctccctgggggctgctaatgcctctggatccctggatccagtgcggtatattgtgatgacccagtacctccactctctctcgtccgtccaccctggacacgccggccctccatcctcctagcaagtcctagtcaagcgtcctcctgacatagtgataggaaatactatttgtatcggtactgacagacggctaacggcacgtctccacatcctactatctaagtctaacgttcagtcgtattccgcgtaggtactgaccgtaggtataggtcaggtggtccacgggtccggggtnaacggctaagacgtaatttaccgactaacgttaacgaaaatcggtaaggcccgggtaggtaggaccggtttaggacgggttagtttacgggttaaggggtttacttacgtaggttaccaggttgaaccgttaggttttaacgtttcccgtttacggtcgggttaactcgggtaccgaacggtacggaaggttaagtaaaccgtactaccggtaacgtacggtcgtaggtccgtggaccctacggttaac

SEQ ID NO: 60371 - DNA, 592 bp, Homo sapiens
  misc_feature: GYAE6OF02I2SV7.17.4.A04.1.454.CMB.1.raw
  modified_base (227)..(227): a, c, t, g, unknown or other
  misc_feature (227)..(227): n is a, c, g, or t
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcaccctggacacgccggcctccatctcctgcaagtctagtcagacgcctctgcatagngataggaaatacctatttgtattggtacctgcagagcagccagtctcactntctctaatctatgtaagttcagtcgacttctctggatcgccagtagttacgtcagtgcaggcggtcaggcacgtagtatttaccaactacgtagtaaaactcgaacgggtcgggtacgggaaggtcgtagggtaaggtaagttaaggttttacgggtttaattacgtgactagtacgtaacgttaacggtttacttttcccggttcggtacgggttaccgtttccgggacccgtaaggggtacccggtaaagggtacggtaaacgtacgtaacgtaaccggtacgttggtcggacctacggtacccacgttacg

SEQ ID NO: 60372 - DNA, 633 bp, Homo sapiens
  misc_feature: GYAE6OF02IELVC.17.4.A04.1.454.CMB.1.raw
  modified_base (215)..(215): a, c, t, g, unknown or other
  misc_feature (215)..(215): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccacttctctctgtccgtcaccctggacagccggctccatctcctgcaagtctagtcagacncctctgcatagtgataggaaagtccttaagtttgtagttcggtacctgacgagaacggcaggcccagtccnccanactctactatctaatgtaagtttcagtcgtacttctcgtggtacgtcgactaagtagttacggtcagggttcgcgtagggccggtacgagctacagtactttacaacacgtaagaaacgtcgaacggtcggggttacggaggtctaggaggtagtttaggtttagggtttaacttcgtcgtactacgtgtacgttaacggtttctttttaccgtcggttaacggttaccggttaccggaccggtaaacggggtaaccgtaaagggttaaccggtaaagtacccggaaaccgtaaccggttacgttaccgggttacggacccgttacggtaccaccgttaaccg

SEQ ID NO: 60373 - DNA, 741 bp, Homo sapiens
  misc_feature: GYAE6OF02IPR7R.17.4.A04.1.454.CMB.1.raw
  modified_base (144)..(144): a, c, t, g, unknown or other
  misc_feature (144)..(144): n is a, c, g, or t
  modified_base (190)..(190): a, c, t, g, unknown or other
  misc_feature (190)..(190): n is a, c, g, or t
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
tcagcgtagactagcacgaccggtgctcgatttagagtagtgatcaggacttctcagttcatcttctcaccatgaggctccctgctcagctccgtggggctgctaatgctcgtggactcctggatccgagtgacggatattggngatcgaccagcctccactctctctcgtccgtaccacccgtggaccncggtcccggcctccattcctcctgactaagttcgtagtacgagactccctctgctaagtgtagagttaggaaactccttagtttaggtagttacggtaccgtgaccgaggaacggcgacggcctaagtcctacacatctacctatcgtagtagtaacttccgagtctattccgagtggacttcgactaaggtattacggtanacgtcggtacgagggccggttanacggtacagtacgtaacttaccaacgtaagttaaacggaaataccgggtacggggtacgggtaggtaagtacggtaagggttaaagttacgggttttaaagggtttaccgggtttaattacgtaaccgggtatttaacggaaccggtttaagtttaaccgggtttttaaccgtttccccggttagggaaccggtttaccgggttaaccccggaagggaaaccgggttaaaccgggtaaggttaaaccggggtaaatcccccgttaaagggtaacgtttaaccgggtcggttaccgtaaccggggtccgttaacccgtggttaaccc

SEQ ID NO: 60374 - DNA, 898 bp, Homo sapiens
  misc_feature: GYAE6OF02GCU9E.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatcgaccagactccactctctctgtccgtcaccccgtgacagcccgcctccactcctcctgactaagtctagtccagacgtccctccgtgactataggtagaataggaaacgtaccgttattttaggtacgtttcggtacctggacaaggtaacggtcacgggcctaggtccttacccaataaccttccgtacctaaagtttctaaagtaccggtaacgttttacccgagttaccgttactttccgtcgtacgggtacgttacgaccctaagggtaacttacgggtttcgaaagggtttcgggaaccgtaaggggttcccggggtacgtaacgggtacccgaacgttaaggtaccttttaacccgaaacccgttacgtaaaacgttaaacgtacccggtaaggggtacccgggggttaagggaccgggttaccgttaggggtaacggttaaggttttaaacgggttttacggggtttttaaacttccggttaccggtaacgtttaacggtaccggggttaaaccggtttaaccgggttttttaacccgtttttttccccgggttaacccgggttttaacccgggggttaacccgggtttacccggggtaacccgggttaaaccggggtaacccggggtaaaaccggggtttaaaccggttaaacccgttaaacccggtaaacccggtaaccggtttaaaccggttaccggggttaaccggttaccggttaacccgggtaacccttacccgttaaccgg

SEQ ID NO: 60375 - DNA, 608 bp, Homo sapiens
  misc_feature: GYAE6OF02I3UUJ.17.4.A04.1.454.CMB.1.raw
  modified_base (181)..(181): a, c, t, g, unknown or other
  misc_feature (181)..(181): n is a, c, g, or t
  modified_base (288)..(288): a, c, t, g, unknown or other
  misc_feature (288)..(288): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacncgccggcctccatcctcctgcaagtctagtcagacgcctcctgcatagtgataggaaactaccttatttgtattcggtacctgcaaggaaggcaggccagtctccanatcctactaatctatagtaacgtttccaagttcgtattcctcgtggacgtcgccaagtagttaggttcaggtcggacagggtccggtacacggcacgtagtactttacaactactagtaaactcgacgggtccgggtaggaggcgtaggaagtagttagtttagggtttaacttacgtgtatagtaggacgttaacggtttacttttaccgtcggttacggtaccggttaccggaccgtaacgggtaaccgtaagggttacggaaacttaccgaacgtaaccgtaacgttcggtacgtacgtacggtacctaccgttacg

SEQ ID NO: 60376 - DNA, 557 bp, Homo sapiens
  misc_feature: GYAE6OF02FP6FY.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctacctaatctatgtaagtttccagtcgattctctggagtgccagataggttcagtggcaggcgggtcaggcacagattcactactagaaaatcaggccgggtggaggtcgtaggaggtagttagttaggggtttattacgtgactagtcgactaaggttacttttccgttccggttggtaccggttccggaccgtaagggtaaccgtaaagggttacggaaacgtaccgtaacgtacggtaacgtcggtacggtcctacggtacctaccgtaacg

SEQ ID NO: 60377 - DNA, 836 bp, Homo sapiens
  misc_feature: GYAE6OF02IRMCP.17.4.A04.1.454.CMB.1.raw
tcagcgtagactagcacgaccggtgctcgatttagagtagtgatcaggacttctcagttcatcttctcacaatgaggctccctgctcagcctcctggggctgctaatgctctggatccctggatccagtgcggatattgtgatcgacccagacctccactctctctgtccctcaccctggaccagcccggcctccatcctcctgacaagtcttagcagcgtccctctgactatagtgaatacggaaactactttagtttaggtacttcggtaccctggaccgtaagggaacgccgaacgggtccctagtcctaccgaactcttacccgtaactaaacgttcgttaacttacgggttaacgtttaccgaggttacctagtttccctggtacgggtacgtcgaaccgttaaggtagtttacggggtactaggggttccggtacgtacgggggtcccgggtaactaacggtacccgtaacgttacccggttaactttaaccccggaacgtttaaccggtaaacgtaaaacgggtccggtaaccgggggtacccggggttaaggacgggttacggtaaggttaacggtagggttttaaaccgggttttagggttacctttacgggtcctaagttaccggtaacgggtttaaccggtttaaggtttttacccgtttcccggggtttaacccgggtccggggtttaaacgggttaccccgggaacgggtaaaacccggggttccggttaaaaggggttaacggtaaaccgtaccctaacccgggtaacggtttaccggtacgggttcccggaaatttcccggtaaccccgttaccttaacgg

SEQ ID NO: 60378 - DNA, 736 bp, Homo sapiens
  misc_feature: GYAE6OF02G14WZ.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtccacccctggacacggcccggcctccactctcctgactaagttctagtcagacgccctcctgctagtagtgaagtaggaaactaccttatttgttagtttacggtacctgcgaaggaacgcgacggccagtccaccgactactcctacctaatcttagtagtaacgtttcgacgttcgtacttctcgtggtacgtcgacgtaagtagttacgggttcgaaggtcgggacgtacgggacggggtacgacggacgacgaagtttaccttacgaacctaacgttaagtaaaactcggaacgggtccgggtagggtacggtacggtagggtaaggttaacggtttagggtttttaggggttttaacttcggttacgtacgtaagttacggtacggtttaaggttttacccgttttttcccgggttaccggtttacggggttacccggtttaccgggtaccggtaaacggggtaacccggtaaacgggttaacgggtaaacctaaccgttaaccggtaacgttaaccggttacgggtcggtacccggtacgttacccgaacccgtttaccg

SEQ ID NO: 60379 - DNA, 627 bp, Homo sapiens
  misc_feature: GYAE6OF02F55BD.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagactccactctctctgtcccgtcacccctggacacgccggcctccatcctcctgacaagtctagtcagacgcctcctgcatagtgataggaaaagtccttatttagtactttcggtacctgacaaggaaggcacggacctagtcctaccactattcctactaatctaatgtaacgttccagtctattcctcgtaggagtcaccgtaagtacggttaggttacagggtcggacgtacgggtacggtcaacggtcaacgtagtactttacacgtaacgtagaaaactccgagggaccgggtgggaggtcgtaggtagtaagttaaggttttgggtttaacttacgttgacgtagtacggacgttaaggttaccttttccgtcgggttacggttaccggttaccggacggtaacggtaaccgtaagggtacgtaaacgtcgaaccgtacgtaacgtggttacggcctagacctacgttaccg

SEQ ID NO: 60380 - DNA, 527 bp, Homo sapiens
  misc_feature: GYAE6OF02G4UTO.17.4.A04.1.454.CMB.1.raw
  modified_base (273)..(273): a, c, t, g, unknown or other
  misc_feature (273)..(273): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctcatctctgcaagtctagtcagagcctcctgcatagtgatggaaagactatttgtattggtacctgcagaagcaggccagtctcanatctactaatctatgtaagtttccagtcgtattctgtggatgaccagtagttaggttcaggtcgactaggcgggtacaggcacgagtattcgacactagaaaatcgagccgggtaggaggctggagtagtagtttagggtttattacgtgactagtgacgtaaggtttacttttccgttacgtcggtacgttcggaccgaaggaaccgaagggtagaaactcgaacaacgtaactcggtagcgagtccactacg

SEQ ID NO: 60381 - DNA, 883 bp, Homo sapiens
  misc_feature: GYAE6OF02GJ460.17.4.A04.1.454.CMB.1.raw
tcagcgtagactagcacgaccggtgctcgatttagagtagtgatcaggacttctcagttcatcttctcaccatgaggctcccgtgctcagctccgtggggctgctaatgctctggactccctggatccagtgcggatatgtgatcgacccagactccactctctctcgtccgtccacccgtggaccagccggcctacattcctcctgactaagtcctagtaccgagacgtcccttccgtgcctaagtaggtgaagttaggaaaacgtaccctttaagttttacgttacgtttacggtaacccgttgtaccgaaacgggtaacggtaccaaacggggtcccctaacggttccctacccgtaaaccgtaacctttcccgttaaccctttaaacttacccgtttaaagttaaccggtttaaaccggttttaccccggtaagtttaacccggttaacgttttccgttccggttaggggtaaacggtttccggaaccctaagggtttaaacggtttacggttttaccgagggttacggggaccgtacggggtccggttaccgaacgggtaccgtaaccgtaaggtttactttaaccgaaacccgtaagtaaacgtaaacgtacgtacgggtcccggggttaggacggttacgagggttaacggttaggtttacgtttttacgggttattaaccggttgtacgtacgtaggtaccgtttaacggtttaccttttacccgggttacgttaccggggttacggttacccgggtaacccggttaacgggggtaaacccgttaggggttaaacgtaaacccgtaccggtaaacccggtaaccggtaccggttacggtaacccgggtctaacccgggtaccctaacgttaccgg

SEQ ID NO: 60382 - DNA, 706 bp, Homo sapiens
  misc_feature: GYAE6OF02IBMPX.17.4.A04.1.454.CMB.1.raw
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
tcagcgtagactagcacgaccggtgctcgatttagagtagtgatcaggacttctcagttcatcttctcaccatgaggctccctgctcagctccgtggggctgctaatgctctggactccgtggatccagtgcggatattgtgatcgaccagacctccactctctctcgtccgtcacccgtggacacgtcccgctcatctcctgacaagttctagtcgagacgtccttcgngactaagtaggtagactaacggaaacttacctttagtttcggtaatttcgggaacctggaccgaaggacggnacggccctaagtcctacacagttccactaatcctaattacgtaactttccgagttacgttaatccgtagttacggacgttanaccgtaagtacggtttaggtaccgtagttcgggaaaccgcgggggttaacccgtcaacgggaccttaacgtacgttaacgtttaccaacgtaaacgttaacgaaaacgttcgggtaacgggtaccggggttaggaacggtcggttaaggaacggtttagtttacggtttaggggtttaacttagtacgtacgtagtacggtacgttaacgtttaccgttttccgacgttacggttaccggtacgtacgggtaacggtaacgtaagggtaacgtaacgtaaccgacgtaaccgtagtacggtcgtacgcgtaccgtactacgg

SEQ ID NO: 60383 - DNA, 745 bp, Homo sapiens
  misc_feature: GYAE6OF02H05F8.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggactcctggatccagtgcgattattgtgatcgacccagacctccactctctctcgtccgtccacccgtggacacgccgcctcactctcctgactaacgtctagcacgacgtcctcgtgactaagtaggtacgtaagtaacggaaacttacctttagttgttaacgttcggtaccagtacgaaggaacggacgtacggaccgtacgtcctaccactactaccttacctaattctagttacgttacttccgtacggttactacttcgtcgtacggtcgtacgacgtagtacggttacggttacggtaggtacggtacggtacgggtcgggtacggaacggtactaacgtacgttaacgttacctaaactaacgtaaacggtaaaacgtcgggtaaccggggtcggggtaaggtacggtaacggtaggggtaacgttaaggttttaggggttttaccgggtttaaagttacgtcggaacttaggtaaccggttagtttaacggttttccgtttaccggtacgggttccggtaacggttacccggaacgggttaaccgggaaggttaacgggtaacgtaactaaccggacggttaacggtacgttcggtaacggtactacccggtacgtacttacgg

SEQ ID NO: 60384 - DNA, 798 bp, Homo sapiens
  misc_feature: GYAE6OF02GT8ZU.17.4.A04.1.454.CMB.1.raw
  modified_base (204)..(204): a, c, t, g, unknown or other
  misc_feature (204)..(204): n is a, c, g, or t
tcagcgtagactagcacgaccggtgctcgatttagagtagtgatcagggacttctcagttcatcttctcacaatgaggctccctgctcagctcctggggctgctaatgctctggatccctggatccagtgcggattattgtgatgacccagacctccactctctctcgtccgtcaccccgtggacacgccggcctcatcctccngcaagtctagtcagacgcctcctgctagtagtgaataggaaactaccttagttagtagttacggactgacgaggaacggcacggcctaggttccaccgtaacacgttacctaaccttaaatcttaagtacggttaacgtttcccgaagttcgttaactttccgttacgtaggggacttacgacccgtaagtaacgttacggtttacgaaggtcggggactacggggtaccgggtacgaacgggtaccaaacgttacgttaacctttaccgaaacgtaaaccgttaaaggtaaaaacgttccgggaaacggggggttacccggggttagggtaaccgggtcggtttaagggaaacgggttacggttttaaaggggtttttcgggttttaaacttacggtagtacgttaacggttaaggttaacccgggttaaggtttttacccgttttaacccgggtttccgggttaacgggttaacccgggtttaccgggaaccgggtaaacgggtttaccgggaaaagggtttaacgggaaaaccttcggaaaccgggtttaacggacggtttacggtccggggtactacggaccctcgtacg

SEQ ID NO: 60385 - DNA, 663 bp, Homo sapiens
  misc_feature: GYAE6OF02F9TZ3.17.4.A04.1.454.CMB.1.raw
  modified_base (429)..(429): a, c, t, g, unknown or other
  misc_feature (429)..(429): n is a, c, g, or t
tcagcgtagactagcacgaccggtgctcgatttagagtagtgatcaggacttctcagttcatcttctcacaatgaggctccctgctcagctcctggggctgctaatgctctggactccctggatccagtgcggatattgtgatcgacccagacctccactctactctcgtcccgtccaccccgtggaccacggcccggccctaccatcctcctgaccaagttcctaagtcaaggtaccgtcccttccgtggactagttaggtacgaagttaagggaaaactacctttagttttggtaatttcggtaacctggacgaaggacggtcgacggccctacgttccacccaactcttcccttacctaattcctaagtacgtaacgtttccagttccgtattcgacgttggagtcgacgtagtagttacgggttnagggtcggatcgggtcggtcacggacagtacgtacttacaccgtaacgtaagaaacgtcgacggtccgggtaggaacggtcgtagggtacgttagttaggtttacgggttttatacgtcgagtagtcgtagttaacgtttcgtttcctacggttcggtacggttccgacgtacggaacgttaaggacgtaagtccgaacgtacggtaacgtccggtagcgtactaccgtatacg

SEQ ID NO: 60386 - DNA, 772 bp, Homo sapiens
  misc_feature: GYAE6OF02HI4M5.17.4.A04.1.454.CMB.1.raw
  modified_base (228)..(228): a, c, t, g, unknown or other
  misc_feature (228)..(228): n is a, c, g, or t
  modified_base (446)..(446): a, c, t, g, unknown or other
  misc_feature (446)..(446): n is a, c, g, or t
tcagcgtagactagcacgaccggtgctcgatttagagtagtgatcaggacttctcagttcatcttctcacaatgaggctccctgctcagctccgtggggctgctaatgctctggactcccgtggactccgaggtcggcggtattatttggtgatcgaacccagacctccactctctctcgtcccgccaccctggacacgccgcctcactctcctgacatctagcagcncctactgactatagtgacgtagggaaactacttatttggtaattcggtaccgtgaccgtaaaggacggcgaacggtcctaggttaccctaccgaactagtcccttaactaacttctagttacgtaacgttttcgacgttactactttcacggttcggaagttcgaccgtaaggtaacgttacgggttatacgggtcggtacgacggggtaccgggtanaacgggacacgtaacgtaacgtttacgaacctaacgtaacgtaaaacgacggtacgggtaccgggggtacggtaagggtaccggtaggtaagggttaactttaggggtttaacgggttttacttaaccgggtacgtacgttagtacggttacggtttaaacgttttacgtttttccccgggttaacggttcggtaacccgggttccgggaaccgggtaaccgggtaaaccggggtaggttaaaccgggtaaaccttaaccggaaccggtaaaggtttaacccgtgggttacccggtaaccgtccggggtaacttaaccccggttcg

SEQ ID NO: 60387 - DNA, 756 bp, Homo sapiens
  misc_feature: GYAE6OF02FMTSK.17.4.A04.1.454.CMB.1.raw
  modified_base (139)..(139): a, c, t, g, unknown or other
  misc_feature (139)..(139): n is a, c, g, or t
  modified_base (204)..(204): a, c, t, g, unknown or other
  misc_feature (204)..(204): n is a, c, g, or t
  modified_base (408)..(408): a, c, t, g, unknown or other
  misc_feature (408)..(408): n is a, c, g, or t
tcagcgtagactagcacgaccggtgctcgatttagagtagtgatcaggacttctcagttcatcttctcaccatgaggctccctgctcagctcctgggctgctaatgctctggatcccgtggatccagtgcggatattgngatcgacccagacctccactctctctgtcccgcaccccgtggacagtcccgcctccatccgtccngctagtcttagcagcgcctctgacatagtgatacggaaacgtccttagtttcgtattcggtaccttgacctaggaacggcgaggtacccgtacgttcctaccacttacgttcctaccttaagttcctagtacgttaacgttccgtacttacggtactttccgtcgtaggggtactccgaccgaagttacggttacgggtttcgnggttacggaccgacgggttaccgggacgacgggactaccgtaagttaaccgtttcgaaccgtaacttaaaggtaaaaccgtccggacggggtaccgggtaggtaaggttccgggaaaggttccggttaagggtttagggttttaggtttttaacctaggttacgacgttaggtaacgtttacgggttaaccggttttttaccttttcccggtaaccggttaccgggggttacccgtttaccgggaccggtaaaccgggtaaacccgggtttagggtaaaccggtaaccgttaccgaaaccgttgttaaccgggtcgtaccgggttaccgaccggtacctaccgttacg

SEQ ID NO: 60388 - DNA, 624 bp, Homo sapiens
  misc_feature: GYAE6OF02G0XJQ.17.4.A04.1.454.CMB.1.raw
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
  modified_base (343)..(343): a, c, t, g, unknown or other
  misc_feature (343)..(343): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtccacccctggacacgcccggcctccatctcctgacaagtctagtcagacgccctcctgcatagtgataggaaanccttatttggtacttggtacctgacaaggacggnacggcacgtcctccactatcctactaatctatagtaacgttccagtcgtattctgtgggtagtcnccgagtagttacggttcgagtcgcgagggcggtacgagcgaacgtatacttacactacgtaacgtaaacgtacggtacgggaccggggtagggaggtcgtaggacggtagtttaggtttagggtttacgttacgtgtacgtagtagtacgttaagtttaccttttccggttacggttcggttaccgggttaccggacccggttttaacgggaccggtaagggtaacggtaaacgtaccgaacgaacgtacggtggtacggtaccgtcgtaccgtacgtacg

SEQ ID NO: 60389 - DNA, 736 bp, Homo sapiens
  misc_feature: GYAE6OF02GZF8F.17.4.A04.1.454.CMB.1.raw
  modified_base (238)..(238): a, c, t, g, unknown or other
  misc_feature (238)..(238): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagcgtagactagcacgaccggtgctcgatttagagtagtgatcaggacttctcagttcatcttctcacaatgaggctccctgctcagctccgtggggctgctaatgctctggatccgtggatccagtgcggatattgtgatgacccagactccactctctctcgtcccgtaccacccctggaccacgcccggccctcctactcctcctacgacgaaacgtcgtacgttacaaggcncccttccgtgacctagtaggtagaattagggaaaacgtacctttagtttagttaacgtttcggtaccttagaccgaagggaacggacgtaacggcctaaggttccaccgtaactactaccttaaccttaatcctataggttaacctttccaaggttcatttccgtactggtaacgtcgaccagtactacggtgtacgngtcgaacgtcggtaanggaactaccgaattacgttacaacgtaaccgtaaagtaaaaccgtcggtaaacggccggggtaacggtaggactacgggtaaaggttaattagggttttagggtttaactaacggttcgaacgttcgtaacgggttaacttaaacgggttttctttccccggttacggtaccggggttaacgtacccgggtaccgtaaacgggtaaccggtaaacggggtgtaaacccgttacgaaaccgtcggttaacccgtgggtaccgtaccggtactacccggtaactcc

SEQ ID NO: 60390 - DNA, 899 bp, Homo sapiens
  misc_feature: GYAE6OF02GRC1W.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcggatattgtgatcgacccagacctccacttctctctcgtccgtccacccctggactacgcccggcctccactcctccgtgactaagtcctagtccagaccgtccctccgtgactagttaggtagtaagtacggaaaactacctttaagttttgttaagttttacggtacccttacgacgtaacggaacggactaacgggaccctacgttacctacctacctaacttccttacccttaaattacttattacggttaacgttttaccaggttacgttacgtttccgtacgttcgggtacgttcgaccgtaaggttaacgttacgggtttacgtacgggtacggacggtacggggttccggggtaaccggaacgggaccgtaaccggttaagttaccgtttaacccgtaaaccgtaaaccggttaaacggtaaaaacgttcccggtaaacgggggttacccgggggttagggtacggggttaaccggtaagggtaaacggggttaacgttttaaggggtttttaacggggtttttaacttaaccggttacggtaacgttaacgggtacggttaaccggttaaacggttttttaacccgtttttacccggtttacccgggttacggtttaacccggggttaccggtaacccggggtaaacggggtaacccgggttaaagggtaaccggttaaacgtaaccccggttaaacgttaaacccggttaacggttacgggttaccggtaccggttaccgaccgtaacccgtttaccgg

SEQ ID NO: 60391 - DNA, 664 bp, Homo sapiens
  misc_feature: GYAE6OF02F03HS.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagacgccctctgcatagtgagtaggaaacgtaccttatttgtattggtacctgcaggaagcagccagtctaccacactctacctaatctatagtacgttccagtcgatttcgtcgttaggtacgtgacctaggaacgttaggtttacaagggttcgggacgtagggtccgggttaccgagggtacctaacgagtaacgtttaccaaccgtaacgtaagtaaaacgtcgaacgggtccgggtagggtaggtccgtagtagggtaagttaggtttggggtttaacttacgtgtacgtagtacggtacgttaacggtttacttttccggttaccggttcggttaccgggtttaccggaccggtaacgggtaacccggtaaagggttaacggtaaactaccgtaacgtaaccggtaaccgttacgggtacggtaccgtacggtacccgtaccttaacgg

SEQ ID NO: 60392 - DNA, 638 bp, Homo sapiens
  misc_feature: GYAE6OF02H0VDO.17.4.A04.1.454.CMB.1.raw
  modified_base (87)..(87): a, c, t, g, unknown or other
  misc_feature (87)..(87): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcacaatgaggctccctgctnagctcctggggctgctaatgctctggactcctggatccagtgcgatattgtgatcgacccagtactccactctcgtctcgtcccgtcacccgtggacacgccgcctcatctctgacagtctagtcagcgcctcgncatagngagtaaggaagtaccttnttgtattcgacctgacaggagcagcctgtctccanttcctactatcttatacgtaacgtttccgagttccgtatttccgtgtagggtacgtcgaccttagggtactttacgggtcgtaggtacggacgtaagggtccggtaggacgtacctaacgtagttacctttacgactaacgtaataaacgtcgtacgggtccgggagacggtcggtacgaaggtttattacggggttttaggtacttacggtagacgttacggtacgtacggtttaacggttttcctttccgggttacggtccggtaacggtttccggaccggtacgggttaacggtaacggtaacgtacgtacgaaccggtacgtcggtacggagtccgtactccgtaacgttccg

SEQ ID NO: 60393 - DNA, 745 bp, Homo sapiens
  misc_feature: GYAE6OF02GW2U7.17.4.A04.1.454.CMB.1.raw
tcagcgtagactagcacgaccggtgctcgatttagagtagtgatcaggacttctcagttcatcttctcaccatgaggctccctgctcagctcctggggctgctaatgctctggactccctggatccagtgcggatattgtgatcgaccagacctccactctcgtctgtcccgtccacccctggaccacgccggcctaccactcctcctagacacgtctagtcacgacgcctctgacagtagtagagtaggaaacgtacttagtttagtagtttacgtacgtacgcgaaggaacgcgaacggtccacgtacctaccaactactcctactaaacttctagtacgtaacgtttaccgtaagtcgtaacttcgtacgttagggaacgtgtaaccgtaagtaacgttaggtcgtaacggtcggaccgtagggtcgggtaccgaggaccgtacgtaacgttagttacaaaccgtaacgttaaagaaaccgttacggcggtaccgggggtggtaacggtagtacggtaaggttaagttaacgggttttaaggggttttacctaaggttcgaacgttacggtacggtaacgtttaaccgggttttccgttttacccggttaacgggttaccgggttaccggtttaacccgggtaccggtaaacgggtaacccgggtaaagggtaacggtaaacgttaaccccggaagtaaccggttaacggttggacggttacggccgtaccgtacccttacg

SEQ ID NO: 60394 - DNA, 830 bp, Homo sapiens
  misc_feature: GYAE6OF02FKE5V.17.4.A04.1.454.CMB.1.raw
tcagcgtagactagcacgaccggtgctcgatttagagtagtgatcaggacttctcagttcatcttctcacaatgaggctccctgctcagctcctggggctgctaatgctctggatccctggatccagtgcgatattgtgatcgacccagactccactctctctcgtcccgtcacccctgacacgccggcctcactcctcctgctaacgtctagtccagacgccctcctgaccataggtgtaagtgggaaaactacccgttattttggtactttacggtaaccctgacaacgggaaggtccaacgggtacccaggttcctaccccgataacgttcccttaacccttaaacgtccttaattaccggtaaacgtttttcccgaaggtttacccgtattttcccgtacgtttgggaaccgttcgtaacctaagggttaccttaggggtttaccgaagggtttcgggccgtaacgggtcggggttaccgacggaccctaacgtaacggtactttaaccgaacgtaaccgttaaggaaaaccgtcgtaacgggtcccggggtaagggaacggtacggtacgggtaagggtaacgttttagggttttacgggttttaagtttaacccgttagtacgttaagttggtaaccggttaacggttttaccgtttttaacccgtttaccggttacgggttaccccgtttaccggggtaccccggttaaacgggggtaacccgttaaaacggggttaacgggtaaaccgtaacccgtaaccgtaaccgggtaaccgttcgggttaacgggtacccgttccggtaacccgtacccgttaacccg

SEQ ID NO: 60395 - DNA, 626 bp, Homo sapiens
  misc_feature: GYAE6OF02G0XX2.17.4.A04.1.454.CMB.1.raw
  modified_base (205)..(205): a, c, t, g, unknown or other
  misc_feature (205)..(205): n is a, c, g, or t
  modified_base (348)..(348): a, c, t, g, unknown or other
  misc_feature (348)..(348): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (586)..(586): a, c, t, g, unknown or other
  misc_feature (586)..(586): n is a, c, g, or t
tcagcgtagactagcacgaccggtgctcgatttagagtagtgatcaggacttctcagttcatcttctcacaatgaggctccctgctcagctccgtggggctgctaatgctctggactcccgtggactccaggtcgcggtattagtttggcgatccggaacccagtacctccacttctccgtctcgtcccgtaccacccgtggacncggcccggtcctacacgttccctcgtagacctaagtcctagtacgaggcctcccgttcgcgctaaggttacgtgacgtaaggtaaacgtctttatttgtacgtttacggtacctgacgaaggtagcgacggctagcctacctntactcctacgtatcgtatcgtaacgttcgngtactattcgtgtcggtncgtactagtcgtagcnggtgacgnggtcggtacngacacgngttatcaacgagttaagatacggtcgggccgggtaggcggtaacgtggtaaagttggttggtttaggtttactacgtggatcggtagtactttacgggtttcttaccggtcggtacgttacggaccgagggaacgttacggaaggttanaccgacgtagacgtaggttcgacgtagtccgtatacttcg

SEQ ID NO: 60396 - DNA, 801 bp, Homo sapiens
  misc_feature: GYAE6OF02FF44Y.17.4.A04.1.454.CMB.1.raw
  modified_base (200)..(200): a, c, t, g, unknown or other
  misc_feature (200)..(200): n is a, c, g, or t
  modified_base (487)..(487): a, c, t, g, unknown or other
  misc_feature (487)..(487): n is a, c, g, or t
tcagcgtagactagcacgaccggtgctcgatttagagtagtgatcaggacttctcagttcatcttctcacaatgaggctccctgctcagctcctggggctgctaatgctctggatccctggatccagtgcggatattgtgatgacccagacctccactctctctgtccgtcacccctggacagccggccttcatcctccncgacaagtctagtccagacgcctaccgtgccgtataacggtgaatcgggaaaacgcccttagttttacggacttttcgggtaccttagccaagggaaacgggctaacgggaccctaaaggttcccgtaccaaacgtatcccttacctttaaacgtccttaagttacggtaaaacgttttccccaaggttacccgtaagtttcccttacgtcggggtacggtgaccccgtaaggtacgtttaacgggtttccgaagggtttcgggaccgtaaggggcccggggtttanacggggaccaaccgtaggtaacttttccgaaacctacttaaggaaaacttcgaccgggtaccggggtcgggaggtcctagggaacggtagttaacgttttgggggttttaacttacggtcgtaccaagttaggtaccgtaaggttttacgttttccctttaccgggacggggttaaccgttaccggggtacccgtaaaggggtaaccccgtaaaggggggtttaaccggtaaaacccggtacccgtaaacccggaaaccggttaacccgttacggggttaccggtaccgttaccggacccgtaacccgttaacg

SEQ ID NO: 60397 - DNA, 617 bp, Homo sapiens
  misc_feature: GYAE6OF02HATI8.17.4.A04.1.454.CMB.1.raw
  modified_base (274)..(274): a, c, t, g, unknown or other
  misc_feature (274)..(274): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (450)..(450): a, c, t, g, unknown or other
  misc_feature (450)..(450): n is a, c, g, or t
  modified_base (605)..(605): a, c, t, g, unknown or other
  misc_feature (605)..(605): n is a, c, g, or t
tcagcgtagactagcacgaccggtgctcgatttagagtagtgatcaggacttctcagttcatcttctcaccatgaggctccctgctcagctccgtggggctgctaatgctctggatccctggatccagtgcggatattgtgatgaccagactcactctctctcgtccgtacacccgtgacacggcccgcctaccgactcctactacgactaagtctaagtcacgactcccttctgacagtgtagatagaaacgtactagtttctagtcggtacngacgagaagcacggtcctacgtcctacgaacctcgtacctacgtaatcttaatggtaaccttcgtagtacccgtnttctcggtaggactagcctaaggtattacgggtcnggtacgnggacggtaggtccaggactacgagtactcactaacgtactaaagtacgacgggtacggngaacggtcgtacgaggtatacggggtttaggtattacggtatacgtagttacggacgttaacgtttacgtttccggtcgttacgggttacgtaccgggtaacgacggggtaacgtacggtaaacgacgttacaacggttaccaaggtggtaccgntaacgctacgtc

SEQ ID NO: 60398 - DNA, 655 bp, Homo sapiens
  misc_feature: GYAE6OF01A968A.37.8.A08.1.454.CMB.1.raw
  modified_base (173)..(173): a, c, t, g, unknown or other
  misc_feature (173)..(173): n is a, c, g, or t
  modified_base (262)..(262): a, c, t, g, unknown or other
  misc_feature (262)..(262): n is a, c, g, or t
  modified_base (363)..(363): a, c, t, g, unknown or other
  misc_feature (363)..(363): n is a, c, g, or t
tcagtagtgtagatcacgaccggtgctcgatttagcatactctacaggggacggtgggagaggacgcccagcactagaagtcggcggttgtttccattcggtgatcggcactgaacacagaggactcaccatggagtttgggctgagctgggtcttctcgtgcttctttaagnggtgtcagtgtcaggtgcacctgggtggagtcgtggggggaggcgtggtccagccgtggggaggtccctgagactctcctgtatgcctntggattcaccttcagctaactatggcatgcacgtgggtcccgccgaggcctccgagggcaacgggggctgggaggtggggtggctaggttatactcgaagnttaggagtagggaacggtgttaggaacgggtatatggcagtacgtcggtaggaaggggccgagtttccacgtactccgtacgaaggacgaacctaacgttacccgaaagtaaccaccgtaacttactaacgttccgtaacgtaactaaacgttacgaaaccgtacggtacgttaacggaacgtaacgtgggaacgggaccgtaaccgggtacgttaggttacgtacgttccgtacgttcgggtaacgtaccggtaaaccggttaaggggggtttagaacggtaggtaccggg

SEQ ID NO: 60399 - DNA, 642 bp, Homo sapiens
  misc_feature: GYAE6OF01C4OBK.37.8.A08.1.454.CMB.1.raw
  modified_base (168)..(168): a, c, t, g, unknown or other
  misc_feature (168)..(168): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtgtcctaggtgctatttaagngtgtcagtgtcaggtgcaccgtggtggagtcgtgggggaggcgtggtccagccgtgggaggtccctgagctctctgtatgcctntggattcaccttnagcaactntggcatgcacgtgggcccncgaggtctcgaggcgaagggtcgtaggnggtgggtggcgtagtagtagtacgagtagtagtagtaggtaaggtaggttaggtaggtagtagtgacgtacgtacgtacggtacggtaacgggaccggtacgtaccgtacctacgtaccgtaccgaacgaacgtaacgtaaacgttaaccgtaaacgaacctaacctaacctacttactacgtacgtaactaaacgtaacgtaacgaacgtaccgtaacgtaacgtaacgtaagaacggaacgacggtacgtacgtagttacgtacgtacgtacggtacggtaaccggtaaccgggtaaggggttagggtaggtaggtacgg

SEQ ID NO: 60400 - DNA, 551 bp, Homo sapiens
  misc_feature: GYAE6OF01EUYSK.37.8.A08.1.454.CMB.1.raw
  modified_base (334)..(334): a, c, t, g, unknown or other
  misc_feature (334)..(334): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctggggggaggcgtggtccagcctgggaggtccctgagactctcctgtatagcctctggattcaccttcagcaactatggcatgcactgggtccgccaggctccaggcaaggggctggagtgggtgcagttanatcagatgatgggaagtgttgaggagtatgcagactcgtgaagggccgattcaccatctcagagacaattccaagaacacactctatctagacaaatcgaacagacctagaacgaactaggaacggaaccaaccgggcgtacggttaggtaacttcgaccgtaggtacggaccgggtaaacccggtaaagggggggttttacggaaggtagtacggg

SEQ ID NO: 60401 - DNA, 579 bp, Homo sapiens
  misc_feature: GYAE6OF01AYKEX.37.8.A08.1.454.CMB.1.raw
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
tcagtagtgtagatcacgaccggtgctcgatttagcatactctacaacacgacaaaggggctaggagagaggagccttagccctggattccaaggcctatccacttggtgatcagcactgagcaccgaggattcaccatggaactggggctccgctgggttttccttgttgctattttagaggtgtccagtgtgaggtgcagctggtggagtctgggggaggcctggtcaagcctggggatccctgagctctcctgtgcagcctctggattcaccttcagtagctatagcatgaactgggtccnccaggctccgagggaggggctgggagtgggtctcatccattaggtagtagtggtacttanatatactacgcagtactcgagtggacgggtcctattccacctactcctacagacgaacaacgaccaaacgactcagtcgtatcgtagacaaagtacgaaccacgtaccgtaggacggaacggacccggaacgggtaacccgaccgggtcttaggttacgttaacgtttacgtgggtacggaccggaacggaccctccccctacccgacccgtacg

SEQ ID NO: 60402 - DNA, 517 bp, Homo sapiens
  misc_feature: GYAE6OF01AV4W7.37.8.A08.1.454.CMB.1.raw
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcttggtacagcctggggggtccctgagactctcctgtgcagcctctggtttcatctttagcaactacgccatgagctgggtccgccaggctccagggaaggggctgggagtgggtctcagggtattacgtggtagtggtaataccgcatactacgcagactccgtgacgggccggttcaccgtctccagagacaattccaagatacggtctatctggaaatgaacagcctgagagccgaggacacggccctctattactgtgcgagagatcgagacggagtangcagcagctntgactcgtcgggg

SEQ ID NO: 60403 - DNA, 560 bp, Homo sapiens
  misc_feature: GYAE6OF01BDH50.37.8.A08.1.454.CMB.1.raw
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggaggtccctgagactctcctgtatagcctctggattcaccttcagcaaactatggcatgcacgtggggtccnccaggcctccgaggccaaggggctgggagtggggtgctagttatatcagatgatggaagtgtagaggagtangcagacgtcgtagaacgggccattcacctatctaccagacgaactaacttaccaaagaacactactactatcagacaaatagaacagacctagaacgaacgtaggaacggaccgaacgggtcgtggtagtactccgacgttggtacggtaccggtaaaccgggttaaaggggggtttgaaggtgtacgg

SEQ ID NO: 60404 - DNA, 493 bp, Homo sapiens
  misc_feature: GYAE6OF01C1IYS.37.8.A08.1.454.CMB.1.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (490)..(490): a, c, t, g, unknown or other
  misc_feature (490)..(490): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggagtccctgagactctcctgtatagcctctggattcaccttcagcaactatggcatgcactgggtccnccaggctccaggcaaggggctgggagtgggtggcagttatatcagatgatggaatgtgaggntangnagactcgtgaggcattcacatctcagagacaatcaagaacacactctatctagacaaatgaacagacctagacgaactggaaggacacggctgtgtatcactgtagacgaaccggtagggggttgagngtg

SEQ ID NO: 60405 - DNA, 552 bp, Homo sapiens
  misc_feature: GYAE6OF01BUCCV.37.8.A08.1.454.CMB.1.raw
  modified_base (297)..(297): a, c, t, g, unknown or other
  misc_feature (297)..(297): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtcttcctcgttgctcttttaagaggtgtccagtgtcaggtgcacctggtggagtcgtgggggaggcgtggtccagcctgggaggtccctgagactctcctgtatagcctctggattcaccttcagcaactatggcatgcacgtgggtccnccaggcctccgagggcaaggggctgggaggtgggtggctaggttatagtcagatgatgggaagttgttgaggagtagtgcagactcgtaggacggccattcacatctacgagacgacaactaccaagaacacactactatctagacaatagaacagtacctagaacgacgtaggacggaccgacggtcgtgttagtactccgacgttagtacggaccggtaaaccgggttaagggggtttaggaggtagtacggg

SEQ ID NO: 60406 - DNA, 692 bp, Homo sapiens
  misc_feature: GYAE6OF01COYGS.37.8.A08.1.454.CMB.1.raw
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtggggggagcgtggtccaggcctggggacggtcctgagactctcctgtatagcctctggatttcacctttnagcaactatggcatgctacgtggggtccnccaggcctccgaggcgaagggctgggagtgggngactagttatatcagntgagtggaagtgtaggaggtagtatgactagtacctccgggtaggaacgggtaccgtaacgtttaccgaacccgtacgtaccgttaccgaacgaacgaacctaaacgtttaacccgaaaacgtaaacctaacctaaccttactaacttaccgttaacgaacctaaaacgttaacggaacctaaccgtaccgttaacggaacgtaaaccgtacgggtaaaccggaccgtaaccgggtacgtttacgggttacgttaaacgttccgtaaccgttacgggtaccgggtaaccgggtaaaacccgggttaaaggggggttttagggaaacgggtaggtaccggg

SEQ ID NO: 60407 - DNA, 510 bp, Homo sapiens
  misc_feature: GYAE6OF01A9WR8.37.8.A08.1.454.CMB.1.raw
  modified_base (333)..(333): a, c, t, g, unknown or other
  misc_feature (333)..(333): n is a, c, g, or t
  modified_base (505)..(505): a, c, t, g, unknown or other
  misc_feature (505)..(505): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggagtccctgagactctcctgtatagcctctggattcaccttcagcaactatggcatgcactgggtccgccaggctccgaggcaaggggctggagtgggtggcagttanatcagatgatggaagtgttgaggagtatgcagactccgtgaacgggccgattcaccatctccagagacaattccaagaacacactctatctagacaaatcgaacagacctagacgaactggaacggacgacggctgtgtatcacgtgtacgacgaacggtagggggttgagngtcgg

SEQ ID NO: 60408 - DNA, 550 bp, Homo sapiens
  misc_feature: GYAE6OF01DBEKA.37.8.A08.1.454.CMB.1.raw
  modified_base (255)..(255): a, c, t, g, unknown or other
  misc_feature (255)..(255): n is a, c, g, or t
  modified_base (339)..(339): a, c, t, g, unknown or other
  misc_feature (339)..(339): n is a, c, g, or t
  modified_base (389)..(389): a, c, t, g, unknown or other
  misc_feature (389)..(389): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggagcgtggtccagcctgggagtccctgagactctcctgtatagcctntggattcaccttcagcaactatggcatgctacgtgggtccgccgaggcctccgaggcgaaggggctgggagtgggtgcagttanatcagatgatggagtgtgagagtatgcagctcgtagaacgacgatcactntctacagacgacaactccaagacactactactatctagactaatacgaacacgacctagacgtaacgtaggaacggaccgacggtcgtaggttagttactaccgtacgttaggtacggtaccggtaaaccgggtaagggggtttacggaaggtagtacggg

SEQ ID NO: 60409 - DNA, 511 bp, Homo sapiens
  misc_feature: GYAE6OF01AGUVN.37.8.A08.1.454.CMB.1.raw
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtcgttcctacggtgctacttttaagaggtgtccagtgtcaggtgcacctggtggagtctgggggaggcgtggtccaggcctggggaggtccctgagactctcctgtatagcctntggattcaccttcagtcaactatggcatgcactgggtccncaggctccaggcaaggggctgggagtgggtgctagttatagtcagatggatggaagtgttgagggtatatgacagactcgtagaggcgatcgacatctcagagactaataccaagacacactctagtctgacaatagaacngtactagagaactgagacgacgcgtgtgtatcgatgacgtacggaacggtaagggggttcaggtgtcgg

SEQ ID NO: 60410 - DNA, 675 bp, Homo sapiens
  misc_feature: GYAE6OF01DDB9J.37.8.A08.1.454.CMB.1.raw
  modified_base (164)..(164): a, c, t, g, unknown or other
  misc_feature (164)..(164): n is a, c, g, or t
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (348)..(348): a, c, t, g, unknown or other
  misc_feature (348)..(348): n is a, c, g, or t
  modified_base (657)..(657): a, c, t, g, unknown or other
  misc_feature (657)..(657): n is a, c, g, or t
tcagtagtgtagatcacgaccggtgctcgatttagcatactctacaggggctgggagaggagcccagcactagaagtcggcggttgtttccattcggtgatcggcactgaacacagaggactcaccatggagtttgggctgagcgtggtctctgtgctattagngtntcngtgtcagtgacnctggtggagtcggngggggtacgcgtggtccgagtcccgtgggacgtccctgacgtctctccgtgtatcgccttcgtggtacttcaccttacagcctaaactgtcggactagtcgacctacggtgggccaccggaggcccgtggacggacggagggggtctagggnggttgggtcgacgttagttacgataggaagtgtagtgtaggtaacgttggttaggaggttacgagtcgacggtagtaccggttcgaacggtacggacccttagttccaacctgttaacccgacgaaggtaaccaaacttaactaaccaaacgtacctactcttatacacgtaacaactaaaccgacgtaacgaccgttacgaagaaaccgttcgaacgggtaaccgtacggtaaccgttggtaccgttaaggttccgtaacggtaacggttacgggtaccggggttaaccgaaagggggttttacgggngaacgttgggtaaccggg

SEQ ID NO: 60411 - DNA, 787 bp, Homo sapiens
  misc_feature: GYAE6OF01ASKIR.37.8.A08.1.454.CMB.1.raw
  modified_base (303)..(303): a, c, t, g, unknown or other
  misc_feature (303)..(303): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtgggtcttcctcgttgctcttttaagaggtgtccagtgtcaggtgcaccgtggtggagtcgtgggggaggcgtggtccagccgtgggagtccctgagactctcctgtatagcctctggattccaccttcagctaactatggcatcgcacgtcgggtccnccgaggcctccgagggccgaagggggctgggtaggtggggtggacgtagttactagtacgagatggagtagggaagttggttaggaaggtagtagtcggacgtaacggtaccgttaccgggtaggtaacggggtcccgtaacgtttaccgaacccgtacgttaccgtaacccgaaggtaaccgtaaccgttaaacgtttaaccccgaaaacgtaaaccctaaccgttaacccgttacctaacgttacgttaaccggaaaccttaaaacgtaccggtaaaaccgtaaccggtacccgttaacgggaaaccgtaaccggttaacggggaaaccgggtaaccccggtaaacccggggttacgtttacggttaaccggttaacgttacccggtaacccggtttaaccggggttacccgggtaaacccggggttaaaccccggggtttaagggggggtttaaaccgggtacggtaacgggttaaccggg

SEQ ID NO: 60412 - DNA, 761 bp, Homo sapiens
  misc_feature: GYAE6OF01DGE23.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtgggtcttcctcgttgctactttaggacgtgtccgtagtgtcaggtgcaccgtggtggtaggcggttttttggggacggtcggtggtccagcggtgggacggtcctgagtactccgtcctgtactacgtccttcgtcggtacttcctaccttaccaaggtaccaacgttagttacggcctagtcgcgtaacgttcgggtaccgaccgaaggtcctaccggacgggcggtaacggggccggtagggtacggtggggtacggtaccgtaagttacgtacgtacgaaggtagtaggtaagtacgggtaaggtaggttacggagggtagtagtgtaccgaagtaccgttacgggaggtaccgggtacttactaccgaccgtaagttccacggtaagaacgtaacttaacggttaccaaaagtaccccaagttaaccttaacggtagtacgttacgaaactaacgttaccgaaacgttacgacccggtttaaggaaacccgtaagttccgggaaccggacgttaccgggttagtcggttaaacgtttacggaccttaccgggactttaacggggaacccgtaacggggggtttaagggtacggttaccgagttaacccgggg

SEQ ID NO: 60413 - DNA, 633 bp, Homo sapiens
  misc_feature: GYAE6OF01E1LKA.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtggggggagcgtggtccagccgtggggacggtccctgacgactctccgtgtatacgccttctggacttccaccttcagcctaaactagtggcagtcgcctacgtcgggtccgccaggcctccgagggcgaaggggctgggaggtggggtgctagttatatcgagtatgagtggtaagtggtaggaaggtagtatggactagtaccgtcggtaggaacgggtccgtattaccgacctatccgtacgaagacgaactaacttaccgaaacgaaaccactaaccttactactactacgaactaaacgtacgaaaccgtagtaccctaggaacgtaaccgtaggaacgggaccgtaacgggtcgtcggttagtactaccgacgttaggacggtaaccgggtaaccgggttaagggggttcggaagtggtaacgg

SEQ ID NO: 60414 - DNA, 518 bp, Homo sapiens
  misc_feature: GYAE6OF01BA634.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggaggtccctgagacctctcctgtatagcctctggattcaccttcagcaactatggcatgcactgggtccgccagggcctccgaggcaaggggctgggagtgggtgcagttatatcagatgagtggaagtgttgaggagtatgcagtactccgtgaacgggccattcacatctcagagacaattacaagaacacactctatctgacaaatgaacagcctagagaacgtgaaggacacggtcgtgtgactcgactgtacggtacggacggtaaggggttaggtagagtacgg

SEQ ID NO: 60415 - DNA, 521 bp, Homo sapiens
  misc_feature: GYAE6OF01C6DHC.37.8.A08.1.454.CMB.1.raw
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
  modified_base (334)..(334): a, c, t, g, unknown or other
  misc_feature (334)..(334): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggaggtccctgagactctcctgtatagcctntggattcaccttcagcaactatggcatgcactgggtccncaggctccaggcaaggggctggagtgggtgcagttanatcagatgatggaagtgttgaggagtatgcagactcgtagaagggccattcacatcncagngacataccaagacacactctatcanacaatagaacagcctagacgaactaggaacggaccacggcgtggtagtatcgacgttgtacggtaccggtaaacggtaggggggtttacgaggtagtacgg

SEQ ID NO: 60416 - DNA, 572 bp, Homo sapiens
  misc_feature: GYAE6OF01E5AB0.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggaggtccctgagactctcctgtatagcctctggattcaccttcagcaactatggcatgcacgtgggtccgccaggctcccgaggcgaaggggctgggaggtgggtcgaccaacgagtacgagggaggtggtaggtaacgaaaaactgtagtggactcgtggtcggcggggccgattcgaccatcctccagacgacaacgtaccaaaactcaactgtatctagacaaagtcggaccgcgtagagtacgtaccggagaccgcggtctaggtagttattagttggtgacggtagtagtaagtttacgaacctaagtaaacgtttcgaagttggacgttggtagttagg

SEQ ID NO: 60417 - DNA, 605 bp, Homo sapiens
  misc_feature: GYAE6OF01EFQX6.37.8.A08.1.454.CMB.1.raw
  modified_base (345)..(345): a, c, t, g, unknown or other
  misc_feature (345)..(345): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtcgtcctgttgctctttaagagtgtcagtgtcaggtgcacctggtggagtctggggggagcgtggtccagccgtgggagtccctgagactctcctgtatagcctctggtattcaccttcagcaactatggcatgcacgtgggtcccgccgacggcctccgagggaccgaagggggctgggagtggggtggctagttanatcgagatgagtggaagttgttggaggtagtagtcgacgagtaccgtcgtaggaacgggtaccgtacgttaccaaccgtatccgtaccgagaacgaactaactaccaaagaaccactactactatctagtacaaagtacgaacgacgtccgtagaacgtaacgtacggaacggaccgaacggtacgtcggtagttacgtcgacgtacggtacggtaaccgggtaaaccgggttaaggggggtttacggaggtaggtacgg

SEQ ID NO: 60418 - DNA, 755 bp, Homo sapiens
  misc_feature: GYAE6OF01DD481.37.8.A08.1.454.CMB.1.raw
  modified_base (327)..(327): a, c, t, g, unknown or other
  misc_feature (327)..(327): n is a, c, g, or t
tcagtagtgtagatcacgaccggtgctcgatttagcatactctacaacgacacaaaggggcctgagagaggagccgttagcccttggattccgaaggcctatccactggtgatcagcactgacgcacgaggtattcaccatggtaactgggctccgtcttgggtttcctgtcgcttattttagaggtgtccagtgtggaggtgcgagcgtggtggagtcggtgggggacgtcctggtacaaggtccgtaggggtaccgtccgtgacgaccgttctccgtaggtcgacctacgtccgtgtggtacttcaccgttgacgtcgccgttanacgactacgtacggaacgtcgggtccgacgtagggtcctcggaaggggttaacgggtcttagggacggttcgggtactaccgtagttccgtaagttttagaggttacggtaggttacctaatagttaacgtacgtaacggctaacgtacgttacgaaggtacggtacgggacctaagttccaacccgttagacccgtacgaacgaacgaacctaacgttacccgaaacgaaccgttaccaacgtttacgtaacgttaccgacggttaaaccaaacgggttaccgaaaccgtacggtaacccgttaggaacgtacgggtaaaccggacggggaaccgtacccgggttaagttggttaaacgttcgttaaacggtccgggtttaacgccgggaaccggttacccggacccccgttagtccccggtaacgg

SEQ ID NO: 60419 - DNA, 748 bp, Homo sapiens
  misc_feature: GYAE6OF01DET8A.37.8.A08.1.454.CMB.1.raw
  modified_base (167)..(167): a, c, t, g, unknown or other
  misc_feature (167)..(167): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttggctgagctggtcttctcgttgcttctttaagngtgtccagtgtcgaggtgccacgtgggtggaggtcggtgggggagcggtggtccgagccgtgggacgtccctgacgtacctctccgtgtatacgccttcgtggtaacttccaccgtttacacgtacctaactagtggacctagtcgaccgtacggtccgggtcccgaccgacggtacccgtaccggaacgggaccgggtaaacgggggccgtttagggggtaagggttgggggtacggtaccgttaaaggttttaataccggtacgtaaggtaagttagggaagttaggggtaaaggttgggttaaggaagggtaacgttagtacggacgtaacggtacccggttacgggaacgggtaacggtaccgtactaccgtaacctacgtactaccgaagaacgaactaaacgtaccaaaacgtaacaacctactactactacgtagaaactaacgtacgtaacacgtaccgtaagaacgaaaccggtaggaaacgaccgtaaggtcgttagttagacgttcccgtaggttacgggtaacggtaaccgggtaaacgggttaaggggttacgtaaggtcgtaacggg

SEQ ID NO: 60420 - DNA, 656 bp, Homo sapiens
  misc_feature: GYAE6OF01B5JRN.37.8.A08.1.454.CMB.1.raw
  modified_base (312)..(312): a, c, t, g, unknown or other
  misc_feature (312)..(312): n is a, c, g, or t
  modified_base (364)..(364): a, c, t, g, unknown or other
  misc_feature (364)..(364): n is a, c, g, or t
  modified_base (508)..(508): a, c, t, g, unknown or other
  misc_feature (508)..(508): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcaccgtgggtggagtcgtgggggagcgtggtccagccgtgggagtccctgacgtactcctctgtatacgccttgtggtacttccgacttcgagctaactagtggctagtgctaccgtgggtccncgaggcctaccgaggccgaaggggctgggaggtggggtcgactaggttatancgagatggagtaggtaggtgttggacggtagtgtggacaaggtcgtcgtagggaacggtcgtaacttccaccgtactccgtaacgacgtaacgtaacctaacgttaacccgaaaacgtaaccaacccttacgtacctttaaccncttaacggaaacctaaacgtaaccgggtaaaccacggtacccgttaagaaaccggtaacgttagggaaccgtaccgacgggtacgttaggttagtcttacgacgtaggtacggtaaccggtaacggggttagggttaggagtgtacgg

SEQ ID NO: 60421 - DNA, 662 bp, Homo sapiens
  misc_feature: GYAE6OF01A6Y3H.37.8.A08.1.454.CMB.1.raw
  modified_base (171)..(171): a, c, t, g, unknown or other
  misc_feature (171)..(171): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcttgggttttcctcgttgctcttttaagnggtgtccagtgtcaggtgcaccgtggtggagtcgtgggggagcgtggtccagccgtgggacgtcctgacgactctctgtatagcctcgtgattccaccttcagcaactntggcagtgctacgtcgggtcccncgaggcctccgaggccgaaggggctgggagtgggtgctagttangtcagtatgataggaagttgtagaggtatacgtgactacggtaccttaccgggaggaacgggtccgtaacgttaccgaaccctacttacccgtaccgaagaacgtaacaacgttaccgaaacgaaccaccgtacttactacgtacctacgaactaaacgtacgaaaccgtacgtaccgtaacgtaacggaacgttacggaacggaaccgtaccgggtacgttggtaacgttacgttaccgaaccggtttacggaaccgggtaaccggtaaaccggggttaaggggggttacggaacgtagggttcggtaaccggg

SEQ ID NO: 60422 - DNA, 591 bp, Homo sapiens
  misc_feature: GYAE6OF01BDUFW.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggaggtccctgagactctcctgtatagcctctggattcaccttcagcaactatggcatgcacgtggggtcccgccagggcctccgagggcgaaggggctgggaggtggggtggctagttatatcagatgatggaagtggtgaggtagtatgacagtactcggtaggaacgggccgtattccacctatcctaccgaagaacgacctaacttaccaaagtaacactactactactctagaacaatacgaactacgacctagaacgtaacgtaggaacggtaccgaccggtcgttagttacgtacgtcgtaccgtggtaccggtaacggtaacccgggttaaggggggttcggtaaggtggtacggg

SEQ ID NO: 60423 - DNA, 636 bp, Homo sapiens
  misc_feature: GYAE6OF01EASI0.37.8.A08.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (397)..(397): a, c, t, g, unknown or other
  misc_feature (397)..(397): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtgggtcttcctcgttgctctttaagaggtgtccagtgtcaggtgcactggtggagtcgtagggggngtcgtggtccagccgtgggagtcccngtacgactctcgtgtatgcctcgtggattccaccttcgagcaaactgtggcagtgctacgttggggcccnccgtaggcctcccgaggacgaacggggctgggaggtgggngactaggttactagacgtagtagtggactaggggattggtacggaggtagngtgacgagtaccggtgtaggaacggcgtatccgacagtcctacagagacctaataccaagaacacacttctatactcgaactaacacgtaacgacgtccgaagtaacggaaccgtagggaaccggtaaaccgtacgggtcgtttaacggtaacttaaccgttaccgaccggtttaagggaccgttaacccggggtaaacggggttaagggggttttcggaaaggtaccggttaacgggg

SEQ ID NO: 60424 - DNA, 736 bp, Homo sapiens
  misc_feature: GYAE6OF01DIXCL.37.8.A08.1.454.CMB.1.raw
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctgggtggagtcgtggggggaggcgtggtccagccgtggggacggtccctgacgactctcctgtatagcctntggacttcaccttcagcaactanggcatgcacgtcgggtcccgccgaggcctccgagggcgaaggggctgggaggtggggtgactaggttanagtcgagtagtaggagtagggaagttggttaggaagggtacgttagtgacgtaggaaccgttcccgggtagggaaccggggtccgtaacgtttaccgaaccctaacgttcccgtaacccgtaacggaacggtaacctaaacgtttaacccgaaaacggaaaccctaacccgtaaccttaccttaacttaccgtaacggaaccttaaaacgtacgtaaacccgaacggtacccgttaaggaaccggtaaacggttacgggaaacgggaacccgtaaccgggtacgttacggttacggttaacttacccggaacgtttccgggtaacggtaaccggggtaaaccgggttaagggggggtttaaagggacggtaaggtaccggg

SEQ ID NO: 60425 - DNA, 559 bp, Homo sapiens
  misc_feature: GYAE6OF01EIHIR.37.8.A08.1.454.CMB.1.raw
  modified_base (372)..(372): a, c, t, g, unknown or other
  misc_feature (372)..(372): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggaggtccctgagactctcctgtatagcctctggattcaccttcagcaactatggcatgcactgggtccgccaggcctccgaggcaaggggctgggagtggggtgctagttatatcagtatgagtggaagtgttggagggagtagngacgagaccgtccggtagaacgggccgattcaacctatctaccgagacgaacaattaccaaagacacactctatctagacaaagtacgaacgacgcctagaagactaggaacggaccgacggtcgtcggttatacgtacacgtggtacgaccggtaaacggtaagggggtttacgaaggtcgtacgg

SEQ ID NO: 60426 - DNA, 660 bp, Homo sapiens
  misc_feature: GYAE6OF01CA5WI.37.8.A08.1.454.CMB.1.raw
  modified_base (308)..(308): a, c, t, g, unknown or other
  misc_feature (308)..(308): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctctttaagaggtgtccagtgtcaggtgcaccgtgggtggagtcgtgggggagcggtggtccagccgtgggacggtccctggagactctcctggtatagcctcgtggtattccaccttcagcaactagtggacatgctacgtgggtccnccgagcctccaggccgtaaggggctagggagggtgggtggctaaggttataagtcaaggattggaagtgggtaaagtggttaggaagggtagttagtggaccgaaggtaccgtaccgggtagggaacgggtcctaagtttccgaacctagttccgtaccgaacgacgtaacctaaacgttaccgaaacgaaccgtactaaccttacgtaacttcgtagaacctaaagtacgaaaccgaccgtacgtaacgaggtaaaccgtaggaacggacgtaacggtcgttaggtactacgtaccgtacgtggtaacggaaccgggaaacgggttaagggggtttgaacgggtgtacggg

SEQ ID NO: 60427 - DNA, 600 bp, Homo sapiens
  misc_feature: GYAE6OF01BZ1WI.37.8.A08.1.454.CMB.1.raw
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (476)..(476): a, c, t, g, unknown or other
  misc_feature (476)..(476): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacgtggtggagtcgtgggggagcgtggtccagccgtgggacgtccctgacgactctcctgtatacgccttgtggacttccaccttcagcctaactatggcatcgcacgtcggggtcccgcgaggcctccgaggcgaaggggctgggaggtgggtggctaggttanatcgaagtntgagtggaagtgtaggaggtagtatgacgagtacctcggtaggaacgggtccattccgactagtccgtaccagaacgaacaacgttaccgaaagaaccactactactatctanaacaactcgaacagaccgtagaaccgagtaggaacgaccgtacgggtcgttaggttacgtacgttcgtacgttaggtacgggtaaccgggtaacggggttaagggggttcgaaggtacgtacgg

SEQ ID NO: 60428 - DNA, 562 bp, Homo sapiens
  misc_feature: GYAE6OF01A0FMZ.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctggggggaggcgtggtccagcctgggaggtccctgagactctcctgtatagcctctggattcaccttcagcaactatggcatgcacgtgggtccgccagggcctccgagggcaaggggctgggagtgggtggctagttatatcgagatgatggaagtgtgaggagtatggacagtactccggtggaacgggccgattcactactctacagagacaattaccaaagaacacactctatctagacaatagaacacgtacctagacgaacgtggaacggacgacggtcgtggtatatccgtacgttacggtacggtaaccgggtaaccgggttaaagggggggtttcggtaaggtaggtacgg

SEQ ID NO: 60429 - DNA, 706 bp, Homo sapiens
  misc_feature: GYAE6OF01CF3PU.37.8.A08.1.454.CMB.1.raw
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
tcagtagtgtagatcacgaccggtgctcgatttagcatactctacgaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcactggtggagtcgtgggggagcgtgtccaggccgtgggacgtccctgacgactctcctgtatacgcctgtggtacttccacctttcaagccaaactagtgggacagtcgcctacgtggggtcccacagggtccaccgagggccgaagggggctagggaggtgggtcgactaggttanatcgaagtatcggtaagtaggtaagttggtagaaggtagttancggactaagtaccgtccggtaaggaacggtaccgtaacgttaccaaccgtaactccgtaaccgaaaggtaacgtaaacgtaaacgttaaccgaaaacgaaacctaaccgtacttaacttaactacgtaacgaactaaacgtaacgaacgtacgtaccgtaaggtaacgaaacgttacggaacggacccgtaacgggtaccgttagggttacgtaaccgtaccgttaacggtacggttaacgggtaacccggtaaacggggttaagggggtttaacggtaacggtaggtaaccggg

SEQ ID NO: 60430 - DNA, 547 bp, Homo sapiens
  misc_feature: GYAE6OF01BO2QF.37.8.A08.1.454.CMB.1.raw
  modified_base (156)..(156): a, c, t, g, unknown or other
  misc_feature (156)..(156): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
tcagtagtgtagatcacgaccggtgctcgatttagcatactctacaacgacacaaaggggctgacgagaggagccttagccctggattccaaggcctagtccacttggtgatcagcgactgagcaccgaggattcaccatggaactggggctccgntgggttttccttgttgctattttagaacggtgtccagtgtgaggtgcagctggtggagtcgtgggggagcctggtcaagcctggggatcctgagactctcctgtgcagcctntggattcacttcagtanctatagcatgaactgggtccncaggctccgagggaacgggctgggagtgggtcncgactccagttagtagtagtggtaacttanatatactacgctagactcgagtgaggggcctattcaccatcnccagagacacgcaagactcactntactctagacaaatcgaaccagccctaggacgtacgaccggacggaccgacgggccttggtacggttacttacgtggtacgacggtaacgacgtccccctaccgacccgtacg

SEQ ID NO: 60431 - DNA, 760 bp, Homo sapiens
  misc_feature: GYAE6OF01DYIMN.37.8.A08.1.454.CMB.1.raw
  modified_base (161)..(161): a, c, t, g, unknown or other
  misc_feature (161)..(161): n is a, c, g, or t
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (187)..(187): a, c, t, g, unknown or other
  misc_feature (187)..(187): n is a, c, g, or t
  modified_base (294)..(294): a, c, t, g, unknown or other
  misc_feature (294)..(294): n is a, c, g, or t
tcagtagtgtagatcacgaccggtgctcgatttagcatactctacaggggctgggagaggagcccagcactagaagtcggcagtgtttccattcggtgatcggcactgaacacagaggactcacatggagtttggctgagctgggtcttcctcgttgcttnttttaagnggtntccagtgtcaggtncacgtggtggagtcgtgggggagtcggtaggtccaggccgtggggaacgtcccgtgaacgtcttcctccgtgttaactcgtcctcgtcggtaactttccaccctttnaacgtacctaacttagtggacagtcgacctacggtcgggtcccgccgtaacggcctaccggacgggacggtaaacgggggtccttaggggacgttccggggtactacggtaaggttaaccgttaggtacggggttaggtaacggttaacctaccggactaaacggttaccgaaccggtacgtaacggtaccccgttccgggtaacggggtaccccggggtacccgtttacccgaccccggttaccgtacccgaacggaacgtaaaccgttaaactacggaaacgtaacgttaccggttattaacgtacggtaaggtaaactacgtaaacgacgacgtaccggaagtaaccggaccgaacgacccggtaccgtacccttagttacgtaccgtggaccggtaagacggtacaggttacaaggggtaaccgagttaaacggtacacgtaaccggcaacgtccgtacggg

SEQ ID NO: 60432 - DNA, 732 bp, Homo sapiens
  misc_feature: GYAE6OF01AT6S5.37.8.A08.1.454.CMB.1.raw
  modified_base (299)..(299): a, c, t, g, unknown or other
  misc_feature (299)..(299): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccaggccgtgggaggtccctgagactctcctgtatagcctctggattcaccttcagcaactatggcatgcacgtgggtccncaggcctccgaggcgaaggggctgggagtggggtgctaggttatagtcagatggagtgggtaagtggttaggaagggagttagtggaccgtaaggtaccgttccgggtaggaacggggtcccgtaacgttacccgaacccgtactacccgttaccaaggtaaccgtaacctaaacgtttaccccgaaaaggaaaccctaaccctaccttaccttaacgttccgtaacgtaacctaaaacgtacgtaaaccgtaacggtacccttaacgggaacgtaaaccgttagggaaaccgggtaaaccgtaccggggtaccgtttacggtacggttaaccgttcccggaaaccggtttcgggttaaccgggtaaacccggggttaaaacccggggtttaaagggggggttttaacgggaaccgggtaaggttacccgggg

SEQ ID NO: 60433 - DNA, 1025 bp, Homo sapiens
  misc_feature: GYAE6OF01B4ORP.37.8.A08.1.454.CMB.1.raw
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (184)..(184): a, c, t, g, unknown or other
  misc_feature (184)..(184): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctggtcttcctgttgcttctttaagngtntcagtgtcaggtnctacgtggtggagtcggtggggagcgtggtccaggccgtgggacgtcctgacgctctctgtactcgtcctgtggtacttccaccttcgagacctaaactgtggcagtcgaccgtacggtcgggtccccgacgtacggcccgtaccggagggaccgaagggggtctaggggtagggttcggggtgacgttagtttaacagttaccgagtactaggtaaggttaggtaaggttggtaggtaagggtacgttaagtcggacgtaacggttaccggtcggggtaacggtaaccgggtaccgttaacgttacccgtaacccgttaaccgttaccgttaacccggaaacggttaaaccgtaaacccgttaaaccgtttaaaccccgaaaaacggtaaacccctaaacccggtttaaccctttaacccgtttaaaccggtttaaccccggttaaaacgtaaaaccccgttaaaaacgggtttaaacccggtaaaacccggttaaacccgggttaacccgtaaaccggggtaaaccgggttaaaacccgggttaaacccgggggtaaaaacccgggtaacccggggttaaaccccggttttaaaccgggggttttaaaacccgggtttttaaaacccggggtttaaaccccccgggtttttaaaaacccggtttaaaccccggggggttttaaaccggggttttaaaaccccccggggggtttaaaaaaccccccggggggggttttaaaaaaccccgggggggttttttaaaaggggggggggggttttaaacccgggtaaaaaccggggggtttttaaccccggggtttaaaaaccccggggggggg

SEQ ID NO: 60434 - DNA, 606 bp, Homo sapiens
  misc_feature: GYAE6OF01B95CK.37.8.A08.1.454.CMB.1.raw
  modified_base (171)..(171): a, c, t, g, unknown or other
  misc_feature (171)..(171): n is a, c, g, or t
  modified_base (508)..(508): a, c, t, g, unknown or other
  misc_feature (508)..(508): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctcgttgctcttttaagnggtgtccagtgtcaggtgcacctggtggagtcgtgggggaggcgtggtccagccgtgggaggtccctgagactctcctgtatagctctggattcaccttcagcaactatggcatgcacgtcggggtccgccgaggcctaccgaggcgaagggggcctgggaggtcggggtggacgtaggttaatagtcgaagagtaggagtgggaagtggttaggaggtagtagtgcgagtacgtccggtaggaacgggccgtagttaccacctatccgtacgaacgtacgaactaacgtaccaaacgaacactactactaactcgtacgactaagtacgtaaacgngacgtagacgtacgaggagaccgacggtcgttggtagtacttaccgacgttagtacggaaccggtaacgggttaagggggttaggaaggtggtacggg

SEQ ID NO: 60435 - DNA, 748 bp, Homo sapiens
  misc_feature: GYAE6OF01DWQ24.37.8.A08.1.454.CMB.1.raw
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagttggctgagctgggtcctcctcgttgcttctttaagaggtgtccagtgtcaggtgcaccgtggtggagtcgtggggggaggcgtggtccaggtccgtggggacggtccctgacgactctcctgtatacgcctctggattccaccttnagacaactatggccagtcgactacgtcggggtcccnccgaagggtccctcccgaagggccgaaaaggggggccttagggaaggttgggggttagaccgttaaggttaactagtccgaaggtagttggaagttaggggaagttggttaggaacgggtagtaagttggacaaggtaccgttaccgggtagggaaacgggtaccgtaacgtttacccgaacccgtaacgtaccgttaacccgaaggtaaaccggtaaacctaaacgtttaaccccgaaaacgtaaaccctaaacctaacccttacttaaccttaccgtaacgaaacgtaaaacgttaccggaaaacctacggtaccgttaacggaacggtaaacgtacgggaaacggtaaccgaaccgggtaccgtaggttacgtaacgtaccacgtacgtacggaccggtaaaccggtaagggggttacggaagtcgtacgg

SEQ ID NO: 60436 - DNA, 820 bp, Homo sapiens
  misc_feature: GYAE6OF01EDL6B.37.8.A08.1.454.CMB.1.raw
  modified_base (172)..(172): a, c, t, g, unknown or other
  misc_feature (172)..(172): n is a, c, g, or t
  modified_base (279)..(279): a, c, t, g, unknown or other
  misc_feature (279)..(279): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggagtttgggctgagcgtgggtcttcctcgttgcttctttaagnggtgtccagtgtcaggtgcacgtggtggagtcgtgggggagcgtggtccaggccgtgggacgtccctggacgtacctctcctgtactcgcctgtggattccaccttnagctaatatggcatcgactacggtcgggtcccgccgaggtcctaccggagggacgaacgggggtctaggggtaggtggggtcgacgttaagttagtacgtacgagtagtggaggtagggtaggttggtaggacgggtagtagtggacgtaagtccgttacgggtaacgggtacgggtacctacgttaccgaaccgtacgtaccctaaccgaagtaaccgtaaccgttaaactaaacccgtaaacgtaaaccctaacccttacccgttaacttaaccgtaaccgtaacgaaaccggttaaaacgttacccggaaaaccgttaccggtaccgttaaaccgggtaaacggtaacccggttaacggggaaaccgggtaccccggtaaacgggttaaccggtttaacgggtttaacccgtttaaacccggttacccgggttaacccggtttaacgggggttaaacccggggtaaacccggggggttaaaaccgggggttttaaggggggttttaaccgggaaaggtttaaccggggttaacccggg

SEQ ID NO: 60437 - DNA, 900 bp, Homo sapiens
  misc_feature: GYAE6OF01AXOHN.37.8.A08.1.454.CMB.1.raw
  modified_base (171)..(171): a, c, t, g, unknown or other
  misc_feature (171)..(171): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagnggtgtccagtgtcaggtgcacctggtgggagtcgtgggggaggtcgtggtccaggccgtggggacggtccctggagaccttctcctggtatagccttctggtacttccacccgtttcaggtaccaaaccgttagtcgggtaccagttcgacccgtaccggttcggggggttaccccgacccggacgggtccccttacccggaacgggggtaccggaaaacggggggggtacccttggggggtaacggggtttccgggggggttacggggaaccgtttaaagggtttttaaactaacgttacccggaaaggggtaactttaggggtaaacggtttagggggtaaaagggtttgggttttaaccgggtaaaagggggttaacggtttaagtaccggggtaaccggtaaacggtaaccccgggtttacggggtacggggtaaaaccgggggtacccgttaacgtttccccgaaacccttaacgttacccgtaaccgaaacgggtaaccgtaaaccgttaaaccgtttaacccgaaaacgtaaacccgtacctaaccgtttctaactacgtacggtaactaaacgtacgaaaccgtagtacccgtagaaccgtaacgtacggaacggtaaccgacggtacgttcggtagttaacgttacccgtacggttaccggtaacggtaaaccgggttaaacccgggggttaaggggtttacggaggttaggtaccgggg

SEQ ID NO: 60438 - DNA, 596 bp, Homo sapiens
  misc_feature: GYAE6OF01A9XAM.37.8.A08.1.454.CMB.1.raw
  modified_base (284)..(284): a, c, t, g, unknown or other
  misc_feature (284)..(284): n is a, c, g, or t
  modified_base (348)..(348): a, c, t, g, unknown or other
  misc_feature (348)..(348): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtcccagccctggggaggtccctgacgactctcctgtatagcctctggtattccaccttcagcaactntggcatgcacgtgggtcccgccaggcctccgagggcaaggggctgggacgtgggtgctagttanatcgagagtgagtgggaagttggttaggaggtagtagtggaccaggtacctccggtaggaacgggaccgtactaccgacctactacctacgaagtacgaactaacttaccgaaacgaaccaacactactatactacgaactaacagtaacacgacgtagaacgaacgtacggacggacgaccggtcgtgtagtactccgacgtgtacggtaccggtaaccgggtaagggggtttcggaggtagtacgg

SEQ ID NO: 60439 - DNA, 583 bp, Homo sapiens
  misc_feature: GYAE6OF01D56LD.37.8.A08.1.454.CMB.1.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggagtttgggctgagctgggtcttcctcgttgctcttttaagaggtgtccagtgtcaggtgcacctggtggagtcgtgggggagcgtggtccagcctggggagtccctgagtactctcctgtatagcctctggatttcaccttcagcaaactntggcatgcacgtggggtccnccagggcctccgagggcaaggggctgggaggtgggtgcagttatatcagatgagtggaagtgttaggaggatagtgcagacgtcggtaggaacggccgtatcactatccacgagacgtacaacgttaccaaacgaacaactactactatactacgaacaacgtagaactacgaccgttaggaacgaacgtaggaacggacgtaccggtcgttgtacggtactacgtaccgtacggtacggtaccggtaaccgggtaaagggggttagggtaggtaggtacgg

SEQ ID NO: 60440 - DNA, 591 bp, Homo sapiens
  misc_feature: GYAE6OF01BRZD0.37.8.A08.1.454.CMB.1.raw
  modified_base (346)..(346): a, c, t, g, unknown or other
  misc_feature (346)..(346): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctggggaggtccctgagactctcctgtatagcctctggattcaccttcagcaactatggcatgcacgtcgggtccgccgaggcctccgaggcgaaggggctgggaggtgggtggactaggttanagtcgagatgagtggaagtgtagaggtagtatgacagtactcggtaggaacgggccgtattccgacctactcctccgaagaacgaactaacttaccaaagaaccaacctactactaatcctagtaactaaagtagaaactacgccgtaggaacgtaacgtaggaacggaccgtacggtcgtacggtagtacgtcacgtgtacggaaccggtaaccggttaaggggggtttacgaggtagtacggg

SEQ ID NO: 60441 - DNA, 663 bp, Homo sapiens
  misc_feature: GYAE6OF01D8AE5.37.8.A08.1.454.CMB.1.raw
  modified_base (171)..(171): a, c, t, g, unknown or other
  misc_feature (171)..(171): n is a, c, g, or t
  modified_base (237)..(237): a, c, t, g, unknown or other
  misc_feature (237)..(237): n is a, c, g, or t
  modified_base (365)..(365): a, c, t, g, unknown or other
  misc_feature (365)..(365): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagnggtgtccagtgtcaggtgcacgtggtggagtcgtgggggagcgtggtccagccgtgggacgtcccngagtacctctcctgtatagccctgtggattctaactttggtagcttattggatggacgtgggtcccgcagtcgtaccgaggggaacggggtctaggaggtcgggtcgaccaaacgagtacggaggggnggtgggtacggtaaacgaaaaacgtgtaggtacggactcgtaggtcggccggggtccgtattccaaccctagttcccgtaccgaacgaacgaaccaaccgtaacctaaaaaccgttcaacgttagtactacgtagaacgtaaagtaccgggacgtaccgtaggagtaccggtaccgaagggaccgacggtacgttggttaacgttattacggttgtacgacggtaggtaagtaatttaacgaactttaacgtaaaggtttcgaggttagtacgttggtaatggtacttgtacttaagg

SEQ ID NO: 60442 - DNA, 785 bp, Homo sapiens
  misc_feature: GYAE6OF01DHP1C.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcaccgtggtggagtcgtgggggagcgtggtccagccgtgggacgtccctgagacctctcctgtactagccctgtggtacttcaccttcacgctaactatggcagtcggcctacgtcggggtcccgcgaggtcctaccggagggccgtaaggggggcttaggggacggttggggtcgggactaaggttataacgttcgaaggtattagggtaagttacggggtaaaggttggttacggaagggtagggttaatcggacctaaggtacccgttccggtagggaaaccggggtccgtaacgtttccgaacccgtactccgtaaccgaaggtaaacgtaacgtaaaccgttaacccgaaaacgaaccctaacctaaccgttacttaaacttaccgtaacgtaacctaaaaagttacgaaacccgtaacgtacccgtaaggtaacggtaaaccgtaacgggaaacgggaaacccgtacggggttacggttaacggtaccgttaacggttaccccgtaacggttacgggttaaccggggtaaccccgggttaaaaacccgggggtttagggggggttttacggaaacgggtaaggtacgggg

SEQ ID NO: 60443 - DNA, 663 bp, Homo sapiens
  misc_feature: GYAE6OF01DIBIR.37.8.A08.1.454.CMB.1.raw
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagtagtgtagatcacgaccggtgctcgatttagcatactctacaacgacacgaaaggggctgagagaggagccttagccctggattccaaggcctatccacttggtgatcagcactgagcaccgaggattcaccatggaactggggctccgctgggttttccttgttgctattttacgaaggtcgtccagtgtcgaggtgcagctgggtggagtcgtgggggagccctgggtccaagcccgtggggggacttcccgtggacgacctcgtccctggttagcctagccctgttgggaactttccaccctttcgaaggtagctaacgtaggccaatgaaccgttggggcccnccagggctccgaaggggaagggctgggagtgggtcncgacgtccaagtttacgtagtaggtggttaaccttacatatactacgcaggacctgaggtcgagggggccagttaccacctagtcctaccgaacgagaccaaaccggacctaaaggaacctcaaccttagtacttccgtagaacctaaagtcgaaacctgacccgtggaacgaccggaccggaggtacgaccgggtcgttaggttacggttaactttaccgtagggttcgacccggtaacggtaccggaccccccttcccgtaaccccgtaccggg

SEQ ID NO: 60444 - DNA, 626 bp, Homo sapiens
  misc_feature: GYAE6OF01B0UL4.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtggggggaggcgtggtccagccgtggggacggtccctgacgactctcctgtactagccctgtggtacttccaccttcagacctaaactagtggctagtgccacgtcggggtcccgccgaggcctccgaggaccgaaggggctgggaggtggggtgctagttatagtcgagatgagtagggaagttggttaggaaggtagtagtggacgacgtaccgttccggtagggaacgggaccgtattaccgaacctatcctacgagaacaactaactaccaaacgaacactactactactctacgaacctaaagtacgaaacgacgtaccgtaggaacgaacgtacggaacggaccgacggcgttacggtagtacgtcgtacgttaggacgtaaccggtaacgggttaaggggttaggagtaggtacgg

SEQ ID NO: 60445 - DNA, 765 bp, Homo sapiens
  misc_feature: GYAE6OF01CB6DB.37.8.A08.1.454.CMB.1.raw
  modified_base (356)..(356): a, c, t, g, unknown or other
  misc_feature (356)..(356): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagccgtggggacgtccctggagactctcctgtatacgcctcgtggacttcaccttcagcaactatggcatgccacgtggggtccaccaggcctccgagggccgaagggggctagggaggtggggtcggctagttanactcaagtagtggagtagggtaaggtggttaggaaggtagtagtcggacgaggtaccgttccgggtagggaacgggtcccgtaagtttacccgaaccgtacgttaccgtccgaaggtaacgaaccgtaaacgtttaacccgaaagtaaaccgttaacgtacgttaaccttaagttaccggttaaacgggtaaaacgttaaccgggaaaccgttaacgggtaccccgttaagggaaacgggtacccgggaacccgggtaaaccggggtaaccccgtaaccccggggtacccctttaaccgtttaaaccgttttaaccggttacgggtaaccggtaacccggaaaggtaaaccggtaaccgttaaccgggtaaacgggtaaaccggggttaacggttaaacgtaacccggg

SEQ ID NO: 60446 - DNA, 639 bp, Homo sapiens
  misc_feature: GYAE6OF01B6764.37.8.A08.1.454.CMB.1.raw
  modified_base (170)..(170): a, c, t, g, unknown or other
  misc_feature (170)..(170): n is a, c, g, or t
  modified_base (304)..(304): a, c, t, g, unknown or other
  misc_feature (304)..(304): n is a, c, g, or t
  modified_base (504)..(504): a, c, t, g, unknown or other
  misc_feature (504)..(504): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagnggtgtccagtgtcaggtgcacctggtggagtcgtgggggagcgtggtccaggcctggggagtccctgagactctctgtatacgcctcgtgtacttcaccttcagtcaactatggacatggctacgtgggtcccnccgaggcctccgagggccgaagggggctagggaggtggggtggactaggttatagtacagatggagtagggtaagttgtaggaaggtagtacgtgacaaggtaccgttcggtaggaacgggtaccgtaattccgaccgtactcctaccgaagtacgaactaacgttaccgaaagtaaccactaaccgtactactacgtanaacctaaatacgaacacgtacgtaaggacgtaacgtacggaacggaccgacgggtacgttggtacgttacgttaccgacgtacggtacggtaaccgggtaaaccgggtagggggtttacggaaggtacgtacggg

SEQ ID NO: 60447 - DNA, 766 bp, Homo sapiens
  misc_feature: GYAE6OF01DNWHP.37.8.A08.1.454.CMB.1.raw
  modified_base (169)..(169): a, c, t, g, unknown or other
  misc_feature (169)..(169): n is a, c, g, or t
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctggtcttcctgttgcttcttttaagnggtgtccagtgtcaggtncaccgtggtgagtcgngggggagcgtggtccagccgtgggacgtccngacgctctctgtatgccttgtgtacttcccgacctttcgaagtacctaacgtagtggacctagtccgtaccgtacggtcggggtcccaccgtacggtcccgtaccggacgggccggaaacgggggtctagggggttacggtgggggtaccggtacgttaaggtttaactacgttcgaaggtagtttaggaggttagggtaaagtttgggttacggaaggggtattacgtaggaccgtaacggtacccggttacggacgggtaacgggcccgttaacgttacctaaccggtacctttaccgaccggaaacgtaacgtaaccctaaacgttaaacccgaaacgtaaaccctacctaacgtttactaacttacgaacgtaactaacgtaccgaacgtaaccgtaccgtaaggaccgtaaacgtacgggaaccggtaccgtacggtcgtacgggttacgttaaccgtaccgtacggtacgtaacccggtaaacgggttaaaccgggggtagggtttaccggaagttcggtaccggg

SEQ ID NO: 60448 - DNA, 745 bp, Homo sapiens
  misc_feature: GYAE6OF01CLF1G.37.8.A08.1.454.CMB.1.raw
  modified_base (173)..(173): a, c, t, g, unknown or other
  misc_feature (173)..(173): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggtagttgggctgagtcttgggtcttcctcgttgcttctttaagnggtgtccagtgtacaggtgcaccgtgggtggaggttcggagggggcgcggtcggtaccgaggccgtgggacgtcctagtacgcttctcctagtactacgtcctcgttggtacttccgaccttcgaacgtacctaaacttcgtaggacctagtcgaccttaccggtcggggtacccgaccgacggacccgttacggaacgggccgggtaaggggtccgtaggggtaacgggttgggttaccggaacttaggtttaagtacgtacgaagtagtggtaaggtagggtaaacgttgggtaaggagtagtaacgtcggactaacgggtacgtcggtaaggtacggacgtactaccgaccgtactacgtacgaagaactacgtaaacttacgaaacgtacctaactacctatacgtactaacgtaactaacgacgtaaccgaggtaccgtaacggaacgaacggtacggaaccggtacggtaccgtacggtaggttacgtaccgttaccggtacggttaacggtaccgggtaacggttaaaccggggtaagggggtttacgagggttaacgtacgggg

SEQ ID NO: 60449 - DNA, 742 bp, Homo sapiens
  misc_feature: GYAE6OF01C8N0J.37.8.A08.1.454.CMB.1.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (398)..(398): a, c, t, g, unknown or other
  misc_feature (398)..(398): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcaccgtggtggagtcgtgggggagcgtggtccagccgtgggacgtccctgagacctctcctgtatgcctntggattcaccttnagcaactatggctatgcacgtcggggtccncaggcctccgagggtcgaaggggctagggacggtggggcgactaggttatactcgaagattggagttgggaagttggttaggaagggtacgtttanggaccgtaaaggtacccgttccgggttaacggaaacggggtcccgtaacgtttacccgaacccgtacgttacccgttacccgaaacggtacggtaacctaaacgtttaaccccgaaaacgaaacccgtaaccgtaacccttaccgttaacgttaccgtaacgtaacctaaaacgtacggaaacctaaccggtaccgttaacggaacggtaaacgttacggaaccgggtaaccgtaccgggtaccgttaaggtacgttaaacgttcccgtaaacgttcgggttacgggtaacccgggtaaaaccggggttaagggggggttttaacggaaggtacgtaaccgggg

SEQ ID NO: 60450 - DNA, 673 bp, Homo sapiens
  misc_feature: GYAE6OF01EW3ZO.37.8.A08.1.454.CMB.1.raw
  modified_base (545)..(545): a, c, t, g, unknown or other
  misc_feature (545)..(545): n is a, c, g, or t
  modified_base (666)..(666): a, c, t, g, unknown or other
  misc_feature (666)..(666): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggtagtttgggctgagcgtgggtcttcctcgttgcttcgttttaaggaggttgtccagtcgtcgaggtgcacgtggtggagtcggtgggggagcgtggtccaggccgtgggacgtcctgacgtacctctccgttgtactacgccgttcgtaggtacttcctaccgttacacgactaactaggtcgacgtagtcgtacctaccggtcgggtcccgccgtacggtccgacggacggacgggaacggggtcgtagggagggtgggtaggtactagttacgtagtacgagtagtagacggtaggtaggttgtaggaggtagtagtacggacgtacgtaccggtgtaacgggacggtcttactacgaccctagtccgtaacgaagtaacgtaactaactaccgaaactaacacctatacctntacagtacaaagcgaactcggaactaaggaacgaccggtaggaaccggtccgaacggtcgttacggtactcgtacgaccggttagaaccggtaccggggtaaacggttaagggtcgtaggngtaacgg

SEQ ID NO: 60451 - DNA, 715 bp, Homo sapiens
  misc_feature: GYAE6OF01DPJBG.37.8.A08.1.454.CMB.1.raw
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
  modified_base (357)..(357): a, c, t, g, unknown or other
  misc_feature (357)..(357): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggagtttgggctgagctgggtcttcctcgttgctctttaagaggtgtccagtgtcaggtgcacctggtggagtcgtgggggagcgtggtccagccgtgggacggtcccgtgacgtactcctcctgtatacgcctctggtacttccaccctttnacgactaactagtcggacaatgcctacgtcgggtcccnccgaggcctcgaggcgagggctgggagtgggcggtacngttatacgtcagtagtaggtagtggtaaaggttggttacggaagggtcgttaagtgactacggtacgttccgggtacggaacgggtccgtaattaccgaccgttactccgtaccgaaaggtaccggaactaaccgttaacccgtaaacgtaaacctaaccgtaaccgttacctaacgtcggtaacgaacctaaacgtaaccggtaacgtaccgtaccgtaacggtaacggtaacggtaaggaaccgggtaacgaacccgggtaccgttacggttacgtacgtaccgttaacgttcgggttaacggaaccgggttaaaaacggggttacggggggtttaagtaacgggtggttaaccgg

SEQ ID NO: 60452 - DNA, 763 bp, Homo sapiens
  misc_feature: GYAE6OF01EU3I4.37.8.A08.1.454.CMB.1.raw
  modified_base (168)..(168): a, c, t, g, unknown or other
  misc_feature (168)..(168): n is a, c, g, or t
  modified_base (180)..(180): a, c, t, g, unknown or other
  misc_feature (180)..(180): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtctcctgtcgctagtttaagngtgtcagtgtgnggtgcacgtggtgagtcggtggggaggtcgtggtccagtccgtagggacgtcctgacnctctctgtancgtcctntagtactctactcaacgctaactncgctagtcncgtacgtcgggaccncgacggtccacgtagggacgtagggcgtgggagggttcgggtaggctaagtttanacgttcaggtagtgggttagtaggggtacgtttgggtacggtaaagggtacgttaacttcgggaacgtacgggtaaccgttccggggtaaggaacccgggttaccgtaacgtttaccgaaccgttaacttacccggtaaccgaacggaaaccggttaaccttaaaacggttcccgaaaaaggtttaacccgaacccttaccggtttacctaacggttacccgaaagttaaacggtaaacgtaacggtaacccgaacggttacggttaacgacggggtaaactcggggaaaccgacggtaacggtttcgacgggtttaattaacggccggtttaaaccgggttggttaaacccgggaaaccgggttaacggggtttaagggttaaccgggtgttaaacgggccggg

SEQ ID NO: 60453 - DNA, 708 bp, Homo sapiens
  misc_feature: GYAE6OF01CU0HX.37.8.A08.1.454.CMB.1.raw
  modified_base (199)..(199): a, c, t, g, unknown or other
  misc_feature (199)..(199): n is a, c, g, or t
tcagtagtgtagatcacgaccggtgctcgatttagcatactctactaacgtacgacaaaggggactgagagaggagccttagccctggattccaaggcctatccacgttggtcgatcagcactgagccaccgaggattcaccatggaatcgggctccgctggtttcctgtgcttatttagagtgtccagtgtgaggtcnctagcgtggtgagtcgtggggagtccgttaggacaaggccgttaggggactcccgtgacgtacgtccgtccggtagtcgacgacgtccctgtaggtaactttccgtaccgttacgaagtacgtcgtaatacggactaacgttacggaacccgttcggtacccctacgacggtcctaccgggtaaggggacggtccgtaggtacgttcggtacctacgtacgttccgttaaggttacgtacggttagtacggttaacctagtaacgttagtaccgtacggactacggacttcgaacggtacggtacgggtacctacgtaccgactacgttcgaccgaagtaccgaaccgaacgtaccgaaacggtactacgaacgttcgtaacttaccgtataacgttaagaacgtaaacctggtacagacggtaaccgacggacgtacggtcgacgttgaacggtttacgacggttcgacggttaccgaaacggtcccgacccctaccgtcgtaaccgg

SEQ ID NO: 60454 - DNA, 768 bp, Homo sapiens
  misc_feature: GYAE6OF01BG9A6.37.8.A08.1.454.CMB.1.raw
tcagtagtgtagatcacgaccggtgctcgatttagcatactctacaggggctgggagaggagcccagcactagagtcggcggtgtttccattcggtgatcggcactgaacacagaggactcaccatggagtttgggctgagctgggtcttcctcgttgctcttttaagaggtgtccagtgtcaggtgcacctggtggagtcgtgggggagcgtggtccagccgtgggacgtccctgagactctcctgtatacgcctgtggtattccaccttcagcaaacttagtggactagtcgacctacgtcggggtccccgaccgacggccctacccgagggaccggaaacgggggtcgtaggggtacggttgggggtaggtaccgttaaggtttaactacgtacgaaggtagtacggtaaggttaggggtaaggttgggttaggaaggtaggtagtcggacgaacggtaccgttaccggtagggaaccgggtaccgtaacgttaccaaccgtactaccgtaaccgaaaggtaacgtaaccgtaaacgttaacccgaaacggtaaacctaaccgtaaccttacgttaacgtaccgtaacgaaaccgttaaacgtaaccggtaaaccgaaccggtaaccgttaaggaaaccggtaaaccgtacggtaacgggaccgtaaccgggttacgttaggttacttaacggtaccgtacggttaggtaacccgggtacgggtaaaccggggttaagggggtttacggaaggttcggtaacggg

SEQ ID NO: 60455 - DNA, 659 bp, Homo sapiens
  misc_feature: GYAE6OF01AT4ZX.37.8.A08.1.454.CMB.1.raw
  modified_base (171)..(171): a, c, t, g, unknown or other
  misc_feature (171)..(171): n is a, c, g, or t
  modified_base (278)..(278): a, c, t, g, unknown or other
  misc_feature (278)..(278): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggagtttgggctgagctgggtcttcctcgttgcttctttaagnggtgtccagtgtcaggtgcactggtggagtcgtggggagcgtggtccagccgtggggacgtccctgacgtacctctcctgtactacgcctgtggtacttccaccttnagtcaactgtcggacatcgccgtacgtcgggtccgcgacggcctcgagggcggtaaggggtctgggacggtggggtacgacgtagttactagtcgagtagtggtaagtagggaacggtttgtagggacggtaacggttagcggtacggtaacggtaccgttacggtaacgggtaacgggtaccgtaacgttccgaaccgtacttaccgaccgtaagaacgtaacgtaacctaccgaaacgtaaccacgtactactatacgtagaactaagactaacgtacgagtacgaaggtacgtacggacgtaccgtacggtcgtacgtagtactacgtacgtaggtaccggtaacgggtaaccgggttaagggttcggagtggtacgg

SEQ ID NO: 60456 - DNA, 728 bp, Homo sapiens
  misc_feature: GYAE6OF01CYUAH.37.8.A08.1.454.CMB.1.raw
  modified_base (169)..(169): a, c, t, g, unknown or other
  misc_feature (169)..(169): n is a, c, g, or t
  modified_base (316)..(316): a, c, t, g, unknown or other
  misc_feature (316)..(316): n is a, c, g, or t
  modified_base (436)..(436): a, c, t, g, unknown or other
  misc_feature (436)..(436): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagttgggctgagcgtgggtcttcctcgttgctctttaagnggtgtccagtgtcaggtgctaccgtgggtggagtcggtgggggagcgtggtccagccgtggggacgtccctgacgctctcctgtatcgcctgtggtacttcaccttcagactaaactgtggcagtcgacctacggtcggggtccccncgacggtcctacccggaagggtcggaagggggtctaggggagggttggggtacgacttaaggttactagtacgaggtagttggaagttagggaagtttgggtaggaacgggtattacggngacgtacgtaccggttcgggtaagggaacgggtccttaacgttaccaaccgtaccttaccggtaaccgaaaggtaaccgtaaaccttaaacgttaaacccgaaaacgtaacctaaccttaaccttacgtaacttacgtaacgtaaaccgtaaagtaccggtaaacaccgtaaccgtaaggaacgtaacggacgggtaacggacccgttacggtacgttggttacgtaactaccgtacggtagggtacgggtaacccgggttaacggggtagggttacggaggttggtacggg

SEQ ID NO: 60457 - DNA, 605 bp, Homo sapiens
  misc_feature: GYAE6OF01CXLB4.37.8.A08.1.454.CMB.1.raw
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (549)..(549): a, c, t, g, unknown or other
  misc_feature (549)..(549): n is a, c, g, or t
tcagtagtgtagatcacgaccggtgctcgatttagcatactctacaggggctgggagaggagcccagcactagaagtcggcggtgtttccaattcggtgatcggcactgaacacagaggactcaccatggattgggctgagctgggtctcctgttgcttacttttaagaggtgtcctagtgtcagggtgcactgggtggagtcgtggggggagtcgtggtcaggtcccgtggggacgttcccagacgacttcctcgtgtaatcgcctgtaggtacttccgaaccgttcagtacctaaacgttatggactaagtcgacctacggtcgggtcccncgaggtcctaccggaggaccgagggntgggacggtgggcgactagttantcgaagntgagtacggagtggtagaaggngtancgatacggtaacgtcgtaggtaccgcgtacttcgaacgtactcgacgaagacgactaactacgaaagtaccaacgtactacttacgacgttacaacgtaacacgtactacgccgtagacgtacgagaccgtacngtcaggtatcgtacctcgtagaccggtacgaacgggttgggtaacgagtgtaacgg

SEQ ID NO: 60458 - DNA, 707 bp, Homo sapiens
  misc_feature: GYAE6OF01CAPTM.37.8.A08.1.454.CMB.1.raw
  modified_base (280)..(280): a, c, t, g, unknown or other
  misc_feature (280)..(280): n is a, c, g, or t
  modified_base (562)..(562): a, c, t, g, unknown or other
  misc_feature (562)..(562): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcaccgtgggtggagtcgtgggggaggcgtggtccagccgtggggacggttcctggacgactcttcctgtatacgcctctggtattcaccttnaagcaactatcggacatgccacgtcgggtcccgccgaggcctccgaagggcccgaaggggcctgggagggttggggtggactaggttactaagtcgtaaggtagtggaagttaggggaaaggtttggttaggtaaggggtaacgttagtacggaccgtaaggtacccggttaccggttacgggaacggggtacccgtaagttacccgaaccctagttacctaccgaaacgtaacgaacgtaaacttaaccgaaacgaaacctaactacctactaatacgtanaaccaagtaagtaaaccacggaccgtaacgtaacggaacgtacggaacggaaccgtaccggtacgtcggttacgtattaccgaacgttacgggtacgtaaccgggtaaaccgggttaagggggttacggtagggtaacgttacgg

SEQ ID NO: 60459 - DNA, 638 bp, Homo sapiens
  misc_feature: GYAE6OF01EE47A.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtggggggagcgtggtccagccgtgggagtccctgagctctcctgtatagcctcgtggattccaccttcagcaactatcggcatcgctacgttcggggtcccgaccgaggcctaccgagggaccgaagggggcgtgggaggttggggtggacgtagttatatcgagatgagtggtaagttggtaggaaggtatagtggactaacggtaccgtccggtagggaacggacccggtattacccgaaccgtatccgtaccgaagtaacgtaactaacttaccgaaacgaacacctactactatcgtagaactaaagtacgaaaccacgtaccgtaaggaacgtaacgtaggtaacgaccgaaccgggtcgtacggtagtacgtaccgacggttacgacggtaccgggtaaacggttaagggggttggaacgtaggtacgg

SEQ ID NO: 60460 - DNA, 686 bp, Homo sapiens
  misc_feature: GYAE6OF01BFM5B.37.8.A08.1.454.CMB.1.raw
  modified_base (162)..(162): a, c, t, g, unknown or other
  misc_feature (162)..(162): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (478)..(478): a, c, t, g, unknown or other
  misc_feature (478)..(478): n is a, c, g, or t
  modified_base (572)..(572): a, c, t, g, unknown or other
  misc_feature (572)..(572): n is a, c, g, or t
  modified_base (613)..(613): a, c, t, g, unknown or other
  misc_feature (613)..(613): n is a, c, g, or t
tcagtagtgtagatcacgaccggtgctcgatttagcatactctacaggggctgggagaggagcccagcactagaagtcggcggtgtttccattcggtgatcggcactgaacacagaggactcacatggtagtttgggctgagctgggtcttctcgttgcttnttttaagnggtntccagtgtcgaggtgcacgtgggtggacgttcggtagggggcgtcggtggtaccaggtccggttgggggacggttccctaggacgtaccgttccttaccgttggtaacttcggcccttagttggtaactttccaccgttacagtacctaaacttgcggactgtggacctacggttcggaccgccgacggtcctaccggagggtacggaacgggggtctagggggtcggttggggtgtaccttaaggttattaacgcggaagtaggttggaaggttagggtagtttaggaggagggtaataccgngggacctaaggtaccggttacgggacgggtaacggtaccgttaacttaccgacctactaccgtacgaacgtaagactaacgtacaaacgtaacnctactagtactctagaacaagtacaacgactaacgtagaanacgacggacgacgtcgtacggtatagttacaacgtcgtacgaaggtaccgtagggtaacggttgagtgtacgg

SEQ ID NO: 60461 - DNA, 939 bp, Homo sapiens
  misc_feature: GYAE6OF01BXUPR.37.8.A08.1.454.CMB.1.raw
tcagtagtgtagatcacgaccggtgctcgatttagcatactctacgaggggctggggagaggagcccagcactagaagtcggcggtgtttccattcggtgatcggcactgaacacagaggactcaccatggagtttgggctgagctgggtctttcctcgttgcttacttttaaggaggttctccagtgtcgaggtgcacgtgggtggagtcgtggggggagcgtggtccagtccgtgggacgtcctgacgtactctcctgtaacgtgcccgttgtggtacttacctaacttaccaggtactaaaccgttagtcggacgtaagtcgaccgtacggttaccggggtacccgccgtaaccgggccttacccggaaggggaccgtaaacgggggcgtttacggggtaagggttggggtacggtaactaagggttttaaataacggttacgtaaagggtaacgtagggtaaggtttacggggtaaaagggtttgggttaacgggaaagggtaacggtttagttacggacccccgggttaaagggtaaacccgttttccccgggggtaaaggggtaaccccgggggttacccttaaaacggtttccccgtaaaccccgttaacgtttaccccggttaaccgaaagggtaaacccgttaaccgttaaaaccgttaaacccgaaaacgtaacccttaacgtaaacccttacggttaaacctacgttaacgtaacgtaaaaccggttcgtaaaacccgaacggtacccttaacggggaataaacccgggtacgggaaaccgggaaccgttaaacgggttcccgtttaaggaacccggggtttaactaaaccggttaaccgggttccggtttaaacgggggaaaccccggggtttaaaacggggggttaaaccgggggtttcggtaaaacgggtaacccggttaacggg

SEQ ID NO: 60462 - DNA, 765 bp, Homo sapiens
  misc_feature: GYAE6OF01EP6SX.37.8.A08.1.454.CMB.1.raw
  modified_base (647)..(647): a, c, t, g, unknown or other
  misc_feature (647)..(647): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctggagctgggtcttcctcgttgtcttcttttaagaggtgtccagtgtcaggtgcaccgtgggtggagttcggtggggggagcgtggtccagccgtgggacgtccctaggacgtacctcctcctggtaactacggtccttcgtggtaactttcccgtaaccttcgaagtacctaaacgttagtacggcctaagtcgacctaccggttcggggtaccccgccgaacggtccctaccggaggggtacccggaaggggggcgttaggggacgggtggggttacggacgttaaggttaactacgtaccgaaggtataggggtaaattagggggtaaacggtttgggttagggaaggggttattacggtcggaacgtaacgggtaaccgttaccgggtagggtaaccgggtcccgttaacgttacccaaccgtaaccgttaccgtaccgtaaacgaacggtaaccttaacgtaacccgaaaacgttaaccaaccgtaccttactacgtacgtaanaactaaacgtaccgaaacgtaccgtacgaagtaacgaaccgtggaacgccgaacggtctaggttacgagtccgtagtcgtacggaacgggtaaacgggttagggtaggacgtgtacgg

SEQ ID NO: 60463 - DNA, 756 bp, Homo sapiens
  misc_feature: GYAE6OF01CNBL4.37.8.A08.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (260)..(260): a, c, t, g, unknown or other
  misc_feature (260)..(260): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagttgggctgagctgggtcttcctcgttgcttctttaagnggtntcagtgtcaggtgcacgtggtggagtcggtggggaggcgtggtccagtccgtgggacgtccctgacgacctctcctgtatacgcctntaggtacttaccaccttcgagacctaaacttagtggactagtcggccgtaacggtcggggtcccgaccgacggccgtaccgagggacggtaaacggggtccgtaggggtaggtcggggtaggaccgtaaggtttactagtcgtaaggtataggtaagtagggtagttcgggttaggaagggtacgtaagtcggacgtaggtacccgtacgggtacgggaaccgggtaccgtaacttaccgaacccgttacttacccgtaccgtaaaggtaacggtaaacctaaaccgttaacccgaaaaccgaaacccttacctaaacgttaccttaacgtaactaacggtaaactaaacgtaacgaccgaacggtccctaaggaacgtaacgacgggaacggtaccggaacggtacgttacggttacgaacgttacccggttagtacggttaaccgggtaaccggggtaaacggggtttaggggtaggggtaaacgtggtaccgg

SEQ ID NO: 60464 - DNA, 637 bp, Homo sapiens
  misc_feature: GYAE6OF01ATDYW.37.8.A08.1.454.CMB.1.raw
  modified_base (170)..(170): a, c, t, g, unknown or other
  misc_feature (170)..(170): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagnggtgtccagtgtcaggtgcaccgtggtggagtcgtgggggaggcgtggtccagccgtgggacgtccctgagctctctgtatgcctntggattcaccttcagcaactntggcatcgcacgtcgggtccgccgaggcctccgaggcgaaggggctgggaggtgggtggctaggttatacgacagatggagttagggagttgtaggaaggtagtagtcggactacggtaccgttcggtagggtaacgggtaccgtacttccgaaccgtactaccgtaccgaagtaacgaactaacttaccgaaacgtaaccaaccgtacctactaactcctagtaacaaacgtacgaaaccacgacctagaacgaacgtacggaacggtaccgacgggtacgtcggttagtactccgtacgttacgggtacggtaacccggtaaacggggttaagggggttacggtaaggtaggtacggg

SEQ ID NO: 60465 - DNA, 690 bp, Homo sapiens
  misc_feature: GYAE6OF01B7G2V.37.8.A08.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtcttcctacgtgctacgtttaagngtcgtcagtgtcgaggtgcaccgtggtggagtcggnggggagcgtggccaggccgtgggacgtccagacnctctctggtanacgcctntaggacttcaccttnaacgactaaacgttgnggacagtcncgtacgtcgggccaccgaaggtccacggaacgggacgaacggggtcttagggaagggttcgggtacgacgtaaagtttatacggagaagattaggagtacgggtaagtttggaacggaggttaatacggtgaaccgtaacgtaccggtaccggtaagggtaacgggtacccgtaattacccgaaactcgttacccgaaccgaaaggaagtaaccctaactaaccggaaaacaaccctacggacccttagtaacgtctaacggaacctaagaacgtaaccgcgaacctaggaacgtaaccgagggaacgaccggtacgtacgttgtacggtaactcggtacgtaaggaccgtaaccgggtaaaacggttaggggttacgaacgtgtaacggg

SEQ ID NO: 60466 - DNA, 798 bp, Homo sapiens
  misc_feature: GYAE6OF01A3ZF0.37.8.A08.1.454.CMB.1.raw
  modified_base (192)..(192): a, c, t, g, unknown or other
  misc_feature (192)..(192): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttacttttaagaggtgtccagtgtcgaggtcnctaccgtggtggacggtcggtgggggacggtcgtcggtaccaggtccgtggggacggtccctaggacgtacctcctccgtagttaatcggtccttcgttaggtaacttcccgtaacctttcgaacgacctaaacgttacgtcggactaagttcgaccgtacggtccggggtccctacccggtaggtccgtacccggaaggggaccggtaaagggggtccgttaagggggtacgggttacgggggttacgaaccgtttaaggtttaacgtacgtacgaaggtagttaggtaaggttagggtaaacgtttgggttaaggaaggttaggtacgtacggaccgtacggtaaccgtcggtaggaaccggtaccgttacgtaccgtaactaccgtacgtacgaacggtaacgtaactaaccgttaacaaaccgtaacctacgtaacctacgttacgttacgaacgtaacctaaacgaccgtaaaccgtacgtaacgttaagaaccggtacgaacgggtaacggtaaccgtacggttacgtacggttagtaccgtagtaccggtagtaccggtaaacgggttaacgggttaaggggttacgaggttgtacggg

SEQ ID NO: 60467 - DNA, 878 bp, Homo sapiens
  misc_feature: GYAE6OF01DVP5O.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatgggtagtttgggctgagtcgtcgggttcttcccgtcgtttgccttacgtttttaagaggttcgtccgagtgtcaggtgcctaccgtgggtggtagttcggtagggggagtccggttggtccgacggccggttggggaccggttcccctaggaacgtaccttccgttccgttagtacgtacggtcccttgttacggtacctttacctacccgtttacgaacgtaaccgttaacgttagttcggactagttcggcccgtaacggttccgggggtacccgaccccgtagggtccccgtacggaacggggtaccgggtaacgggggccgtttagggggacgggtttcgggggtacggtaaccgttaaggttttaacgtacgttacgtaaaggtacgttaggttaaggtttagggtaaaggtttggtaaggtaacggttaaggtacgtacggaccgtaacgggttacccggttaccggggtaggtaaccgggtccgttaaccgttacgaccgttacctaccgttaccgaaacggaacgtaaaccttaaacgttaccgaaacgtaacccgtaacttaccgttactaacgtacgaacgtaaaccgaacgtaccgtaaacgacgtaccgtaaggaacgtacggtaaggaaccggtaccgtacggtaccgttaggttacgttacggtacgtaaccggttacggtaaccgggttaaaccggggttaaacgggttaggggtttaaggacgttggttaaccgg

SEQ ID NO: 60468 - DNA, 707 bp, Homo sapiens
  misc_feature: GYAE6OF01EQWGD.37.8.A08.1.454.CMB.1.raw
tcagtagtgtagatcacgaccggtgctcgatttagcatactctacagggggctgggagaggagcccacgcactagaagtcggcggtgtttccattcggtgactcggcactgaacacagaggactcaccatggagtttggctgagctgggtcttcctcgttgctcttttaagaggtgtccagtgtcaggtgcacctggtggagtcgtggggggacggcgtggtccaggccgtggggacggtcccctggacgaccttctcctggtactacgcctctaggacttccacctttcagacaaactagtcggcagtgcctacgtcggggtcccgccgacgggcctaccggagggaccgaaggggctgggaggtggggtcgactagttacagtacgagtagtgaagtggtaacgttggttaggaacggtagtacgtaggaccgtaacggtaccggttacccggtagggaaccgggtacccgtaacgtttacccaacccgtaacttaccgtaacccgaaaggtaaccgtaaacctaaaccgttaaccgaaaaccgaaaccctaacctaacccgttacttaagtacccgtaagaacctaaacgtacgaaccacgtacgtaggaacgtacgacggaacggacgtacggtcgtacggtatactcgtaacgtcggtaacgggaccggtaaaccgggttaaggggttagaaaggtgtacgg

SEQ ID NO: 60469 - DNA, 741 bp, Homo sapiens
  misc_feature: GYAE6OF01BG9PH.37.8.A08.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagtagtgtagatcacgaccggtgctcgatttagcatactctacaggggctgggagaggagcccagcactagaagtcggcggtgttccattcggtgatcggcactgaacacagaggactcaccatggagtttgggctgagctgggtcttcctcgttgctcttttaagaggtgtccagtgtcaggtgcacctggtggagtcgtgggggagcgtggtccagccgtgggacggtccctgagactctcctgtactagcctctggacttcaccttnagtcaactgtggcatgaccacgtcggggtacccnccgtaggcctccggaggccgaaggggtctaggggagttggggtagacgtaaggttatacncgaagtagtggaagtgggtaagttgggttaggaaggtaacgttaagtcggacgtaacggtacccgttaccggtagggaacgggtacccgtaacgttacctaaccgtacgttacctaccggaagtaaaccgtaacgtaaaccgttaacccgaaaacgtaaacctaacctaaccgttacctaacgttaccgtaacgtaaccgtaaaacgtaccgaaacggtaaccggtaccgtaacggtaacggtaaacggttacggaaaccggtaaccgtaaccgggttacgttacgggttaagttaaccttccggaacgttacggtaacgggtaacccgggtaaacggggttaaacggggggtttggaacggttaggtaaccggg

SEQ ID NO: 60470 - DNA, 593 bp, Homo sapiens
  misc_feature: GYAE6OF01B6CBG.37.8.A08.1.454.CMB.1.raw
  modified_base (165)..(165): a, c, t, g, unknown or other
  misc_feature (165)..(165): n is a, c, g, or t
  modified_base (213)..(213): a, c, t, g, unknown or other
  misc_feature (213)..(213): n is a, c, g, or t
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
tcagtagtgtagatcacgaccggtgctcgatttagcatactctacaggggcgtgggagaggagcccagcactagaagtcggcggtgtttccattcggtcgatcggcactgaacacagaggactcaccatggagtttgggctgagctgggtcttcctcgttgcttnttttaagaggtgtccagtgtcaggtgcacgtggtggagtcgtgggggngcgtgggtccaggcctggggacggtcctgagactctcctgtatgcctntggattcacttcagctaactatggctatgcacgttcgggccncaggcctcgaggcgaaggggctggagtgggtgctagtntancagatgagtggaagtggttgaagggtatagnggntaacgacgtccggtggaacgggcgtaattccgaccgtataccgtacgaaggacacgtaaacttaccgaaacgtaacacctactataacttcggataacgaactaagacgagaccgtaagacgtaacgaggacgacgtacggcgttacgtagacgttccgaacgttggaacggtaacccgtaaggggttaacggggtttagaagggtctaacgggg

SEQ ID NO: 60471 - DNA, 767 bp, Homo sapiens
  misc_feature: GYAE6OF01B2KQI.37.8.A08.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (491)..(491): a, c, t, g, unknown or other
  misc_feature (491)..(491): n is a, c, g, or t
  modified_base (534)..(534): a, c, t, g, unknown or other
  misc_feature (534)..(534): n is a, c, g, or t
  modified_base (708)..(708): a, c, t, g, unknown or other
  misc_feature (708)..(708): n is a, c, g, or t
  modified_base (724)..(724): a, c, t, g, unknown or other
  misc_feature (724)..(724): n is a, c, g, or t
tcagtagtgtagatcacgaccggtgctcgatttagcatactctacgaggggcgtgggagaggagcccagcactagaagtcggcggtgtttccagttcggtgatccggcactgaacacagaggactcaccagtgggtagtttgggcctggacggtccgttcgggttcctttcccgttcggtttcgacctttacgtttttaaaggnggttcgtaccctagttcgtcgaggtgccgtaccgttgggtggtagtcggtagggggngcggttggtccagtccgtggcgtccgtgacgtcttctcgtgtactacgtccgttcgtggtactttccaccgtttcgaacgtacccaaacgttgttcggacctaagttccggcctaacgggtttccgggaccccgtaccggaacggtcccgttaaaccggacgggaacccgggaaaggggttccggttgggaacgggtcgggggttacgaccgtttaagttagttaaccgngtaaagtcgtaggtagtaagggttaagttggtacggtaagggngtttacgacggtacgtaaggtacccggtaagggtaccgggtaacgggtcccttaacgttacccgtaaccctacgttaccgtaccgtaaacgacggtaaacctacgtaaccgaaactacgactactagtacctgacgtacaagtaccagaacgtcagacgagagaacgctacggngttgagtactaaccgngtacgtaacggtacggtacgggtaagggtgaaaggttgaacgg

SEQ ID NO: 60472 - DNA, 754 bp, Homo sapiens
  misc_feature: GYAE6OF01CCUBG.37.8.A08.1.454.CMB.1.raw
  modified_base (62)..(62): a, c, t, g, unknown or other
  misc_feature (62)..(62): n is a, c, g, or t
  modified_base (577)..(577): a, c, t, g, unknown or other
  misc_feature (577)..(577): n is a, c, g, or t
  modified_base (647)..(647): a, c, t, g, unknown or other
  misc_feature (647)..(647): n is a, c, g, or t
  modified_base (663)..(663): a, c, t, g, unknown or other
  misc_feature (663)..(663): n is a, c, g, or t
  modified_base (671)..(671): a, c, t, g, unknown or other
  misc_feature (671)..(671): n is a, c, g, or t
  modified_base (729)..(729): a, c, t, g, unknown or other
  misc_feature (729)..(729): n is a, c, g, or t
tcagtagtgtagatcacgaccggtgctcgatttagcatactctacaacacacgaaaggggcngagagaggagccttagccctggattccgaaggcctatccacgttggtgatcgagtcacgtgacgcgaccgaggacttcaccagtcggaacttggggcctccgtcgtttcgggttttccttggttgtacttagtttaaggaggtcgtccgtaggtgtaggtaggtcgcgtaggtcgtgggtgggaggtcgggtggggacgtccgtggtacgaacggtccggtaggggctcccgtagtacgtcctccgttcgtagtcgcgtaccgtctgtacggtacttcctaccgttcaaggttcgacgttagtacggtacgtacgtaacggtaccgggtccggttaacccgccggaacggtccccggttaaggggacgggggtaaccggggtgttacggggtacggttcccggtatccgtaacgtttaccgtaaggttagggtacgttaacgggttacttaacgttactaacgttactacgagtacgtacgtacgtttcgggaggacgggtacgggtaccttacncgtaacctagtccaacgaggtaaacacccgaacgtaacgaaacctcctaacgtacgttaccacacgtaanaaccggtaatacgacncgtaacgnggaaacgcggttaaccgaggtaccgtcgtacgttagttacgtagtcgtagtaaccggnggactacccgaccttccgaatccgg

SEQ ID NO: 60473 - DNA, 735 bp, Homo sapiens
  misc_feature: GYAE6OF01A1S5W.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttctttaagaggtgtccagtgtcaggtgcaccgtggtggagtcggtgggggaggcggtggtccagccgtggggacggtccctgacgactctcctgtactacgcctcgtggtacttccaccttcacgactaactagtcggcagtcgcgtaccggttccggggtacccggccgacgggtccctacccggaacgggaccggaacgggggtcgtaggggtagggttggggtcggacgtaggtttaactagtacgaagtagtggtaagtaggtaagttgggtaggaagggtagtacgtagacgaacggtaccgtaccgggtaggaaccgggtcctacgttaccgaccctaactccgtaacgaacgaacgaacctaaaccttaccgaaacgtaccaaccgtacttactaacgtaccgtacgaactaaacgtacgaaccaccggtacctaaggaaccgtaacggtacgggaaacggtacccgtaagggttcgttacggtaccgttaacgtacccgtacggttaacggttaccgggaaaccgggttaacggggtaaaggggtttacggaaggttacggtacgg

SEQ ID NO: 60474 - DNA, 709 bp, Homo sapiens
  misc_feature: GYAE6OF01DA8VM.37.8.A08.1.454.CMB.1.raw
  modified_base (189)..(189): a, c, t, g, unknown or other
  misc_feature (189)..(189): n is a, c, g, or t
  modified_base (275)..(275): a, c, t, g, unknown or other
  misc_feature (275)..(275): n is a, c, g, or t
tcagtagtgtagatcacgaccggtgctcgatttagcatactctacgagggggctgggagaggagcccagcactagaagtcggcggtgtttccattcggtgatcggcactgaacacagaggactcaccatggagtttgggctgagctgggtcttcctcgttgctctttaagaggtgtccagtgtcaggtncacgtgggtggagtcggtggggggagtcgtggtccagccgtgggacgtcctgagtctctactgtactagcctgtggattcaccttnacgctaaacgtagtcggacctagtcggctaccggttcgggggtccccaccgacggtcctacccgaggggcggtaaacggggcgttaggggaggttcgggggtaggaccgtaggtttaagtacgtacgaaggtagttaggaagttagggtaacggttgggttaggaacgggtagttaagtcggacaacggtaccgtaccggtacgggaacgggtaccggtacttaccgtaccctacttaccgtacccgaagtaacgaacgtaacttaaccgaaacgtaacctaacctaaccgtactacgttacgtaacgtaactaagtacgaaactacggtacgtacgacgaacgtacggaacggacgtacggtacgtcgtagtacgtacgtacgtacggtacggtaaccggtaagggttaacgggggttcgaaggtcgtacggg

SEQ ID NO: 60475 - DNA, 756 bp, Homo sapiens
  misc_feature: GYAE6OF01AB6MJ.37.8.A08.1.454.CMB.1.raw
  modified_base (140)..(140): a, c, t, g, unknown or other
  misc_feature (140)..(140): n is a, c, g, or t
  modified_base (166)..(166): a, c, t, g, unknown or other
  misc_feature (166)..(166): n is a, c, g, or t
  modified_base (366)..(366): a, c, t, g, unknown or other
  misc_feature (366)..(366): n is a, c, g, or t
tcagtagtgtagatcacgaccggtgctcgatttagcatactctacaggggctgggagaggagcccagcactagaagtcggcggtgtttccattcggtgatcagcactgagcacagaggactcaccatggaattgggctgngcgtggtttctgtgctatttggagtntccagtgtgaggtgcaagttgggtcggaggtcgtgggggacggccgtcgtccgagccgtggggggtccctagagtacctcttcccgtgttgtcgccttcgtacgtaacctttccccgtttaacgggtcctttagttggatcggtacgtccgtcgggtccccggaccgacgggccgtaccggaaggggagggtccgtgggngttcggggacgaccaaacgagtaaaacggcgtaaaggtaggtaggaaaggtaaaggaacgggtagttatcggtagggtaccttcgggttaggtacgggtaaccggggttccctttaccaccgttaacgttccaaccgaaggtaccgaaccgaaccgtaaccgaaaccggtaccctccggtactacgtacttccgtaaggactaaacgtacaagtacgttagaccgtaacggaccggtaaccgggaaggacccgtaaggtacttttaagttaacttccggttacggcggtacggtaaacggaacgggtagggtaccggtcgggttacggttacgacccggtttagggaccggggtaccgaccggttacccggctcccggtaccgttcccgg

SEQ ID NO: 60476 - DNA, 655 bp, Homo sapiens
  misc_feature: GYAE6OF01B52C1.37.8.A08.1.454.CMB.1.raw
  modified_base (174)..(174): a, c, t, g, unknown or other
  misc_feature (174)..(174): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (315)..(315): a, c, t, g, unknown or other
  misc_feature (315)..(315): n is a, c, g, or t
  modified_base (598)..(598): a, c, t, g, unknown or other
  misc_feature (598)..(598): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggagttgggctgagcgtgggtcttccgtcgttgcttcgttttaagnggttcgtccagtgtcgaggtcgaccacgttgggtggagtcggtgggggagcggtggtccaggcctggggacgtcccnggacgtctctctgcgcanccgtctggttcattcttagcaacgtcgcagtcgagtcgtcggtccnccgacggcgtaccggaaggggacggggtctaggggacgttacgggtctacggtaaggtttattaccggtagggttaaggtacggtaaacgtaccgcgtaacgttacgaccgtacgacggtaaccgtcggtacggtacccgggtcccgttacggacccttccggtaccgaagaacgaccgtaacgttacccgaaagtacgttaacgtacgtacgtacgtaggtaaacgtagaccgaagtccgtagacgtacgcgtacggacgaccgtcctacgtatcgtgtcgngaacgtgacgagacggaagcgaagtgacgaggactacgactctaggacgttaccggg

SEQ ID NO: 60477 - DNA, 856 bp, Homo sapiens
  misc_feature: GYAE6OF01EZ3U7.37.8.A08.1.454.CMB.1.raw
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggtagtttgggctggagcgtggtcttctgtgcttactttagngtntcagtgcaggtncacgtggtggagtcggtggggagcgtcgtccgaggtccggtagggacgttcctagacgtaccttctcgtagtacgtacgtccttcgttaggtacttaccgaccgttacgacgtaccgttaactgtcggactagtccgtaccgtacgggtccgggtaccccgtacccggtaacggtccccgtacgggtaacggggtaaccgggtaacggggtccggttaaggggtacggggttcgggggtccttaaaccggttaacggttttaacgttaccgaggtaaaacggtggttaacgggtaacggggttttaaggggtaacgtttaggggttaacggtaagggttacggtttacctaggggtaacccgtaacggggttaaccccgggtaacgggttacgggaaacccggtttaccttaaccgtaccctaacgtacgttaccctaacggtaacgtaaccgtaaccttaaacgttaccaaacggttaccctattaccttaacgtacttaaccgagtaaacccttaacggacggtaaatcccggtaaatccgggtaaaacgccggtaacgggccgttaccgggtaacgttaacgggttacttcgtaaaccggttccgagggttaaccgtaaccgggggttaacggggtttaaaagggcgggtttacggctaacgggtacgg

SEQ ID NO: 60478 - DNA, 817 bp, Homo sapiens
  misc_feature: GYAE6OF01BX54L.37.8.A08.1.454.CMB.1.raw
tcagtagtgtagatcacgaccggtgctcgatttagcatactctacagggctgggagaggagcccagcactagaagtcggcggtgtttccattcggtgatcggcactgaacacaggaggactcaccagtgggtagtttgggctgagcgttgggtccttccgttcgttcgtcttacgttttaaggaggttcgtaccgtaggttcggttcgtagggttcggttaccgttgggtagggtacggttcgggtgggggggacggtccggttcgggtcccgacgggtccggtacggggtacggttccccgtggtaaccgtaccgttccgttaccgttaggttacgtaccggtcccttacggtacggttaaccttcctaccccgttgaacgtaacctaacgtaaggtcggacctaggttcgaccgttacggtcgggtccccgaccggtcggttacccgaccggaaccggggtacggaagggggtccgttaagggggacgggtttacggggcggtaaccgttaagttaacgttagaccgtaggtagtagtaggtagggttaaggttaggtaggaagggtataggtacgcggtaagtaccggtacgtagggaccggtacgtactccaccgtagtacccacgtacgaactacgtaaccgtaaccgaaacgtacccgaactactaacctcgtaacaccgaaactaactacgaaccgtaccgtacgtaagaacgtacgtaacgaacggtcgaaccgtcggtagttactacgtacgtacgtacggtccggtaaagggtaccgggtaggggtaagtcggtagtcggtaacggg

SEQ ID NO: 60479 - DNA, 812 bp, Homo sapiens
  misc_feature: GYAE6OF01D4UHE.37.8.A08.1.454.CMB.1.raw
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
  modified_base (261)..(261): a, c, t, g, unknown or other
  misc_feature (261)..(261): n is a, c, g, or t
tcagtagtgtagatcacgaccggtgctcgatttagcatactctacagggggcgtgggagaggagcccagccactagaagtcggcggtgtttccgattcggtgatccggcactgaacacagaggactcaccatggagtttgggctggagctgggtctcctgttgcttntttaagnggtncagtgtcaggtncacgtggtggagtcgtggggggagcgtggtccagtcgtggggacgtccctgacgtactctcgagtactacnccttcgtaggtacttccaccttcgaacgtactaaaccgtagtcgggacctatcgaccgtaacggtcgggggtcccgacccggtaagggtcccgtacccggaaggggaccggtaaagggggtccgtagggggtaagggttcgggggtacggtaccgtaaaggtttaataccgtagtaaaggtagttagggtaagttagggggtaaagttgggttagggaacgggggtaagttacggttcggaccgtaaacgggtacccggttaccggggtaaggggtaacccgggtccccgttaaggtttacccaaaccggtacttacctaccggaagtaaccgtaacctaactaacccgaaacgtaaacccaccgtaaccgttacttaaccgtacgtaacgaacgtaaacgtaacggtaaccgaaaccgttaccgaacggtaaacgggtaaccgttaaggaaccgggtaccgtaacgggtacgttaggttaccgttacgtacgtaccgttaaggaccggtaaccgggttaacggggttaggggttacggaggtgtaccggg

SEQ ID NO: 60480 - DNA, 736 bp, Homo sapiens
  misc_feature: GYAE6OF01B2CKC.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttctttaagaggtgtccagtgtcaggtgcacgtggtggagtcggtgggggagcgtggtccagcgtgggacgtccctagacgactctctgtatcgcctcgtggtattcctaccttcagacctaactagtggctagttcgacctacggttcgggtccccgccgacggtcctaccggagggccggaaggggtccgtaggggacggttggggtcggtccgtaaggttttatacgtcgaggtaagtcggtaagtagggtaaggttaggttaggaagggtagttagcgacgtaacgtacgtccgggtaggaaccgggtccgttaccaacgtacgtaccgtacggaacggtaactaaacgttacccgaaagtaaccgtactaacgttcgtaccttacgtaaccgaaacgtaagtaacgaaaccggtacgtaccgttaggaacgtaacggtacggaacgggtaaccgtaaccggttacctttaaagttacgtttaacggttggttaacgggtaacgggttaaaccggtacccgttaaccgttacccgtaaccccgttaagtaccggtcgtacgggttacccggg

SEQ ID NO: 60481 - DNA, 672 bp, Homo sapiens
  misc_feature: GYAE6OF01BFGD1.37.8.A08.1.454.CMB.1.raw
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
tcagtagtgtagatcacgaccggtgctcgatttagcatactctacaggggctgggagaggagcccagcactagaagtcggcggtgtttccattcggtgatcgacactgaacacagaggactcaccatggagtttgggctgagctgggtcttcctcgttgctcttttaagaggtgtccagtgtcaggtgcacctggtggagtcgtgggggagcgtggtccagcctgggaggtccctgacgactctcctgtatagcctctggattccaccttcagcaactatggcatgcacgtcggggtccnccaggcctccgaggcgaacggggctgggacgtggggtcgacgtagtttanagtcaagatgagtgggaagttggttaggaggtacgtagtcgactacggtaccgtaccggtagggaacgggtcccgtacgttaccacccgtacgttacctaccgaacgaacgaacgtaaccttaccgaaacgaaccaaccgtaaccgttacttaacgttaaactcgaactaaaacgtacgtaaaccgtaacgtacccgttaaggaaccgtaacgtaacgggtaacggaaccgaccgggtacgttaggtacgttacgtacgtaccgtggtaccgggtaacgggtaaaccggggttaaggggggtttacgtaagggtcgtacggg

SEQ ID NO: 60482 - DNA, 702 bp, Homo sapiens
  misc_feature: GYAE6OF01D814Q.37.8.A08.1.454.CMB.1.raw
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (193)..(193): a, c, t, g, unknown or other
  misc_feature (193)..(193): n is a, c, g, or t
  modified_base (401)..(401): a, c, t, g, unknown or other
  misc_feature (401)..(401): n is a, c, g, or t
  modified_base (569)..(569): a, c, t, g, unknown or other
  misc_feature (569)..(569): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccagtggacgtttgggctgagctgggtccttcctcgttgcttcttttaagngtntccagtcgtcgaggtnccacgtggtacggaggtcggtggggggacgtcgtcggtaccacggtccgtagggacgtccctagacgaccttctcgtagtaactcgtcctagtagtacttcctaccttcgacgactaactgtacggacagttcgacttaacggtcgggtccaccgtagtccaccggagggcgtaacggggctagggaggtcgggaccgtatagttaanagtacgagtagtagtaagtaggtaggttagttaggaaggttaacgtagtcggaaccgtaacgtacggttaccgggtaaggtaaccgggtccctaagttaccacgttacgtactaaccggaagtaaccgtaactaacgtacccgaaagtacctaacgtactaacgttanacgtaacgaataacgtacgaacgtcgtactaaggactacggaaggtaccgaccggtacgtgtttaaccgtatacgtaccgtaacggtcggaacggtaacggttaaccggggtaaggttcgaacgtgaaccggg

SEQ ID NO: 60483 - DNA, 768 bp, Homo sapiens
  misc_feature: GYAE6OF01BY668.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtggggggagcgtggtccagccgtgggacgtccctgagacctctcctgtatgcctcgtggacttccaccttcagtcaacctagtcggcaagtcgcctacgtcggggtcccgccgtagggcctacccgaggggtaccgaaacggggggccttgggtaacgggtgggggtcggtaccgtaaaggttttacgtactcgtaaggtagttaggagtacggggtaaaggttacgggtttggaaggggttaagttacgtaggaccgtaaggtacccggttaccgggtagggaaccggggtaccgtaacgtttaccaacccgtacgtaacccgtacgaaggtaaccgtaaccgtaaacgttaacccgaaaacgttaaccgaacccttaacgttccggtacctacgttccgaaacgttaaagtaaccgtaaaccggtaccgtcgtaacggtacggtacgggtaccgaacggggtacccacccgggttacctttagtaacgtttacgttggttacgggtaacgggtaacgggtaccccttaccggtaacccgttccccgttaagtccggtaaccgg

SEQ ID NO: 60484 - DNA, 810 bp, Homo sapiens
  misc_feature: GYAE6OF01DMXPF.37.8.A08.1.454.CMB.1.raw
  modified_base (171)..(171): a, c, t, g, unknown or other
  misc_feature (171)..(171): n is a, c, g, or t
  modified_base (242)..(242): a, c, t, g, unknown or other
  misc_feature (242)..(242): n is a, c, g, or t
  modified_base (675)..(675): a, c, t, g, unknown or other
  misc_feature (675)..(675): n is a, c, g, or t
  modified_base (758)..(758): a, c, t, g, unknown or other
  misc_feature (758)..(758): n is a, c, g, or t
  modified_base (800)..(800): a, c, t, g, unknown or other
  misc_feature (800)..(800): n is a, c, g, or t
tcagtagtgtagatcacgaccggtgctcgatttagcatactctacagggggctgggagaggagcccagcactagaagtcggcgtgtttccattcggtgatcggcactgaacacagaggactcacagtgggagttgggctgagcgtggttcttctcgttgcttcgtttaagnggtcgtcctagtgtcgaggtcgcctacgtgggtcggaggtcgggtaggggggacggtccggttcggcccgngggtcccgggtacggggtaccggtcccgttacggacgtacctttccgttaccgttagttaaccgtcggtccccgttaggtcggttaacttcccgttaccttacgaaccggtaactaaaccgttgtcgggtacctaagtcccgggtactaccgggtccgggggtccgccggacggtacccgtccggaacgggcgggtaaacgggtcgggtaggggtcgggttcggggtaggtaaccgtttaggttaacgaccgtaggtaacgtagttggaaggtaggggtacgttgggtaggaacggtagtacgtgaccgtaacgtccgggttacggtacgggcggtaacctccgtaaccgtacgtaccgtaccgtacgtaaccggaactaaccgtaaacgtaacccaagtaaacccggtaacttacttactaccggttaaacnccggaaacttaacggaccgtaaaccgttccgaaccggtaagtaaccgaggtaaaccggtcggaaaccgtcgtacgtaccgtanacggtctacggtaggaacggtaccgggtaaacggtgggacgngttcgacggg

SEQ ID NO: 60485 - DNA, 779 bp, Homo sapiens
  misc_feature: GYAE6OF01DSXSM.37.8.A08.1.454.CMB.1.raw
  modified_base (168)..(168): a, c, t, g, unknown or other
  misc_feature (168)..(168): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggtagttgggctgagctgggtcttctgttgcttctttaagngtgtccagtgtcaggtgctaccgtggtggagttcgtgggggtagcgtggtccagtccgtggggacgtcccgtgacgtacctcgtccgttgtatcgcctacgttggtaacttccgtacccttcgaacgtacctaaacgttacgttacggacttagttcgacccgtaacgggttcggggtccccgtacgaaccggggttcctacccggaaggggttacccggaaaaggggttccgtaaggggtaacggtggggttacggacgtaacgtttagttacctggtaagtaagtacggacggttagggtaaagttcggttaaggaaggtagtagttcgacgtacgtaacgtcggtacggtaagggtacccgtagttccaaacgtacgttacgaacgagtaacgacctaacgtaccgtaaagtacccacgtaccttacgtaactacgagtaactaacgtaagtaaccgcgtaaccccgtaggtaacgtaaacggtaacggtaccggaaaccgtaacgggtaaccgtggtttaagttacgtaccgttaggttaccggtaaacgggttaccgggttaaaacccggggttagggggtttaacggtaacgtaggttaaacggg

SEQ ID NO: 60486 - DNA, 703 bp, Homo sapiens
  misc_feature: GYAE6OF01CWKK7.37.8.A08.1.454.CMB.1.raw
  modified_base (168)..(168): a, c, t, g, unknown or other
  misc_feature (168)..(168): n is a, c, g, or t
  modified_base (186)..(186): a, c, t, g, unknown or other
  misc_feature (186)..(186): n is a, c, g, or t
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
  modified_base (343)..(343): a, c, t, g, unknown or other
  misc_feature (343)..(343): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggatttgggctgagctgggtctcctgttgcttctttaagnggtgtccagtgtcaggtncaccgtgggtggagtcgtggggggagcgtggtccagccgtgggagtcccnggagactctcctgtatgccctntggacttcaccttcagccaactntggcatcgcgtacgtcggggtcccgcaggcctcgagggccgaaggggcctgggaggtggggngtacgtagtttagtacgtcgaaggtactaggacgtgggtaaagttggttaggacgggtagtactcggacgtacggtaacccgttcgggtaacgggtaaccgggacccggttacgttaaccgtacccgtaccgttaccgtacccggtaaggtaaccgtaacgtaacctttaacccgaaaacgtaacctaaccctaacgtaccttaagtcctaacgaactaaacgtacggtaacctacggtaccgtagggaacgtaacgtacggaacggtaaccggtcggacgttacggtacttacggtccgtaacggttcgggtacggtaaccgggtaacgggttaagggggtttacgaagtggtaccggg

SEQ ID NO: 60487 - DNA, 667 bp, Homo sapiens
  misc_feature: GYAE6OF01EDLAM.37.8.A08.1.454.CMB.1.raw
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (287)..(287): a, c, t, g, unknown or other
  misc_feature (287)..(287): n is a, c, g, or t
  modified_base (576)..(576): a, c, t, g, unknown or other
  misc_feature (576)..(576): n is a, c, g, or t
  modified_base (591)..(591): a, c, t, g, unknown or other
  misc_feature (591)..(591): n is a, c, g, or t
  modified_base (602)..(602): a, c, t, g, unknown or other
  misc_feature (602)..(602): n is a, c, g, or t
  modified_base (611)..(611): a, c, t, g, unknown or other
  misc_feature (611)..(611): n is a, c, g, or t
  modified_base (658)..(658): a, c, t, g, unknown or other
  misc_feature (658)..(658): n is a, c, g, or t
tcagtagtgtagatcacgaccggtgctcgatttagcatactctacaggggctgggagaggagcccagcactagaagtcggcggtgttccattcggtgatcggcactgaacacagaggactcacatggagtttggctgagcttgggtcttcctgttgcttctttaagagtgtccagtgtcaggtncctacgtggtgagtcgnggggngtcgtgtccngcctgggcgtcctagacgtacttctcgtgtactacgtcctgtagtacttcctaccttcgactacaaattgnggctagtcgacgtacggtccgggtcccgaccgacggtccctaccgggacgggtacccggtaagggggccgtttaggggacgggtttcggggtacctacttaaaggtttaatacgtgaacgttacgtaggtacggtttgggaacggttttgtagggaaacgttgtagttcggacctacggttaacggccgggtaaggtacggtacccttagtaccctaacgtactccgacgaaagtcgaactaactcaaacgtacacttaacttcagtactgaaacctagtcgaaacgtnacgggtgaacctacngaaccggtacncgtgttcgngttacacggtcgtgtaaccgggacgtaaacggggttgggaaccgtancggtaacgg

SEQ ID NO: 60488 - DNA, 813 bp, Homo sapiens
  misc_feature: GYAE6OF01COAIK.37.8.A08.1.454.CMB.1.raw
  modified_base (439)..(439): a, c, t, g, unknown or other
  misc_feature (439)..(439): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccagtggtagtttgggctgagcgtgggttcttccgttcgttgtctttacgttttaaggaggttcgtcctagttgtacgaggtgccgtaccgtgggtacggagttcgggtggggggaggtcggttggtcccgaaggtcccggttaggggtaccggttccccgtaggacgtacctttccttaccgttagtactcggtcccttagttggttaactttccctaccgtttacgacgactaaacctagtcggactagttcggcctaccggttcgggggtccccaccgaacggtccctaccggagggtaccggaacgggggtntaggggtagggttggggtacggtactaaggtttaactcgtagaagtagtaggagttaggtaagttggtacggaagggtataggtcgaacgtacgtacgtcggtagggaacggtccgtacgtaccgaccgtataccgtacgaaacgacgtaactaacgtaacgaaacgtaacctaacctaccgtacttactacgtacaacgtaaaactacgtaaaccgtacgtaccgtaaaggtaacgaaacggtaacgggacgtaaccgtacgggtaccgttagggttacccttaacggttaacccgttaacggttacgggaacccgggttaaacgggtaaacccggggttaggggtttaacggtaaaccggttggtaaccggg

SEQ ID NO: 60489 - DNA, 631 bp, Homo sapiens
  misc_feature: GYAE6OF01DNENI.37.8.A08.1.454.CMB.1.raw
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (495)..(495): a, c, t, g, unknown or other
  misc_feature (495)..(495): n is a, c, g, or t
  modified_base (559)..(559): a, c, t, g, unknown or other
  misc_feature (559)..(559): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctcgttgcttcttttaagaggttgtccagtgtcaggtgcaccgtggtggagtcggtggggggagcggtggtccagccgtggggacgtccctgacgacctctcctgtatcgcctntggacttcnccttcagcaactatggcatgcgacgtcgggtccgccagggctccgaagggtcgaacggggcgtagggtaggtggggtcggaccgaaacaagtaaaggcgaaaggtagtagggaaaacgtaaaggaaagggagtagtaggtggtactcggtaggtaggtaaacgggtccgtttacgacctagtctaccgagacgaacaacgaccaaagaaccgtaccggnactagtcgtagaacaatagaactagtctagacgagaccgagacgacggtacttagttattacgngtacggcgtaaggaggaacgggtacgtacggggtcggtttacggaccgtacgggcgggtccgtaaaccgggg

SEQ ID NO: 60490 - DNA, 769 bp, Homo sapiens
  misc_feature: GYAE6OF01C118W.37.8.A08.1.454.CMB.1.raw
  modified_base (177)..(177): a, c, t, g, unknown or other
  misc_feature (177)..(177): n is a, c, g, or t
  modified_base (257)..(257): a, c, t, g, unknown or other
  misc_feature (257)..(257): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggtagtttgggctggagcgtgggtccttcctcgttgcttactttaaggnggtgtccaggtgtcaggtgctaccgtgggtggagtcggtgggggaggcgtcggtcgagccgtgggtacttcccgagaacnccgttctccgtgtactcgcctcgtagtacttccaccttacacgactaactagtggactagtcgacgtaccggtccggggttacccgaccgtacgggtcctaaccggaacgggtacccgggtaaagggggtccgtaggggtacgggtcgggggtgaaccggttaaggttaataacgtacgaaggtataaggacggttaagggtaggttaacggtaggtaacgggtagttaaccgtgaaccgtaacggtacccggttacgtaacggggtacgggcccgttaagttaccgaacccgttaagtaccctaaccggtaaacgaacgtaaacgtaaaccgttacaaaaccggtacaacccgtacctacgttaccgtactaacgacgtaaactaacgactacggtacctagacggtagtaaccgggaacgaccgtacgacggttagtaccgttactccgtacgtacgtacgggtaaaaccgggtacggggttaagggttaaacggggctcgggtaaacgg

SEQ ID NO: 60491 - DNA, 739 bp, Homo sapiens
  misc_feature: GYAE6OF01BVQEP.37.8.A08.1.454.CMB.1.raw
  modified_base (173)..(173): a, c, t, g, unknown or other
  misc_feature (173)..(173): n is a, c, g, or t
  modified_base (176)..(176): a, c, t, g, unknown or other
  misc_feature (176)..(176): n is a, c, g, or t
  modified_base (236)..(236): a, c, t, g, unknown or other
  misc_feature (236)..(236): n is a, c, g, or t
  modified_base (387)..(387): a, c, t, g, unknown or other
  misc_feature (387)..(387): n is a, c, g, or t
tcagtagtgtagatcacgaccggtgctcgatttagcatactctacaggggctgggagaggagcccagcactagaagtcggcggtgtttccattcggtgatcggcactgaacacaggaggacctcaccatgggagtttgggctggagcgtggtcttcctggtgcttctttaagngtntcgagtgcaggtgctacgtgggtcgagtcggtggggagcgtgtccagccgtgggcgtccngacgctctctgtactgcctgtaggactttccgaccttagagtacctaacgttagtcggactagtcgacctacggtcgggtacccgcgtacggtcctccggaaggtacccggaagggctagggtacggtcgggtggtaacccttaggttaanaccgtggtaagtacgtaaggtaacggttagggtagttggtaaggggtgttaaacgtgtaacggaccggtaaacgtcggtttaccggtaaggaaccgggtacgtactaaccgtactacgtaccgtacgtaacgtaacgtaacgtaccgtaaaccgtaacgtaacctaaccttactacggttaccctacggtaaccgaacctaaccgtaacgtaaccggtcgtaacgtacggtaacgtaacggtacgtaaccggaccggtaaccgttacgtacggggtattaccggtcgtaacgttacccggtaacgggtaaccggttacgggttaaaggggttcggaaacggtgtaacccggg

SEQ ID NO: 60492 - DNA, 783 bp, Homo sapiens
  misc_feature: GYAE6OF01ALGS3.37.8.A08.1.454.CMB.1.raw
  modified_base (164)..(164): a, c, t, g, unknown or other
  misc_feature (164)..(164): n is a, c, g, or t
tcagtagtgtagatcacgaccggtgctcgatttagcatactctacaggggctgggagaggagcccagcactagaagtcggcggttgtttccattcggtgatcggcactgaacacagaggactcaccagtggagtttgggctgagcgtggtcttcctgtcgtctnttttaagaggtcgtactagtgtcgaggtcgcgtacctgggtggagttcgggcgggggtaggccgttcggccgacggccggtcgggtacggttccccgtaggaaccggtccttccgtccgttacgttaacgtccggtccgttcgtacggtttaacctccttaccgtttacccgagtaaccgtaaacgttacgttcggaacctaggttcccgaccgtaacggtcccggggtaccgcccgacggtccgtacggacgggtacggggaacgggtcgtaacgggtagggtcgggtcgtacgttaacggtatactcggaagtgtaggtaggttaggtaaggtttgggagggacgtttaaggtagtcggtaacccggtagttaacccggtcgggtaacgggtaacggtaccgtaacgtcctaacggtacttaccggtacgtaacgtaaccggaacttaaaccggtacgtaaacgaaaccttacttaacccgtatacgtaactcgaaacgtactaacggacctaacgacgtaggaactagtacgacgtacgagttaccgtcggttaactcgaaacgtcgtagggtaccggtaacgggttaacgggtagggtacgaacggtgtaccggg

SEQ ID NO: 60493 - DNA, 750 bp, Homo sapiens
  misc_feature: GYAE6OF01B8F6L.37.8.A08.1.454.CMB.1.raw
  modified_base (632)..(632): a, c, t, g, unknown or other
  misc_feature (632)..(632): n is a, c, g, or t
  modified_base (734)..(734): a, c, t, g, unknown or other
  misc_feature (734)..(734): n is a, c, g, or t
tcagtagtgtagatcacgaccggtgctcgatttagcatactctacaggggctgggagaggagcccagcactagaagtcggcggtgtttccattcggtgatcggcactgaacacagagactcaccatggagttgggctgagcgtgggtcttccgtcgttgcttacgttttaaggaggtgtcctaggtgtcgaggtcgcgtaccgtgggtggacggtcggtgggggacggtcgtggtccgagtccgtgggacgtccgtgacgacctcgtctgtactacgtcctcgtaggtcttacccgtaccttacgacgtacctaaacgtgtcggacctagtacgccgtaccggtccgggtcccgaccgaggcctaccggagggaccggtaaggggtcgtagggagggttcggggtagtaccttaaggtttactaagtccggtaagtacgttaagggaggttaaggtaggttagggtaggaagggtagttaagcgacggtaacgtaccgttacgggacggaccggtaccgttaacgtacaccgtactaccgtacgaacgtaaggaaccttaacgttaaccgaaaagtacccgaacctacgttaaccgtacttacgtaacgtaaacttaacgaaccggtaaacnccgggtaaaccgagtaacgaaaccgtaggaacggtaccgtacgtcgttacgttagaacctggaaccggtagaccgggttaaccggaacggggttaaagggtnaacggtcggtaacggg

SEQ ID NO: 60494 - DNA, 698 bp, Homo sapiens
  misc_feature: GYAE6OF01C0OPO.37.8.A08.1.454.CMB.1.raw
  modified_base (174)..(174): a, c, t, g, unknown or other
  misc_feature (174)..(174): n is a, c, g, or t
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (447)..(447): a, c, t, g, unknown or other
  misc_feature (447)..(447): n is a, c, g, or t
  modified_base (559)..(559): a, c, t, g, unknown or other
  misc_feature (559)..(559): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (689)..(689): a, c, t, g, unknown or other
  misc_feature (689)..(689): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccagtggtagtttgggctgagtcgtgggtcttcctgttgcttatttaaggngtgtccagtgtacgaggtncctacgttgggtcggaggtcggnggggggagcggttcggtaccaggtccggttggggacgttcccgaggactaccttccgttccttggtaacgtccggtccttgttacggtactttaccaacccgtttggaacaacttaaacgttaggccgacgttagtccggacgtaccggttaccggggcccctacggacggccgtacggaagggacgtagggggtctaaggggtggtgggtacgactagttacactcgagngtaaggtcgttaagggaagttccggaaggtaggaacttggagacgtacggcgttgaagggtacggtccttaacgtcaaccttgtactaccgaaagacgtaacctaacgtaanaaaccgctaacctactnttaacngtaacaaaccgtataccgaactcgacgaagaccgttagacggagcccggtagtcgtaggtacgtactcgtacggttaggacccggtaagggtaaaccgggtgggacnggtaggtcg

SEQ ID NO: 60495 - DNA, 811 bp, Homo sapiens
  misc_feature: GYAE6OF01CEZCR.37.8.A08.1.454.CMB.1.raw
  modified_base (158)..(158): a, c, t, g, unknown or other
  misc_feature (158)..(158): n is a, c, g, or t
  modified_base (190)..(190): a, c, t, g, unknown or other
  misc_feature (190)..(190): n is a, c, g, or t
  modified_base (688)..(688): a, c, t, g, unknown or other
  misc_feature (688)..(688): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtgggtcttcctgtntcttacgtttaagaggtgtcagtgtcgaggtnctacgtggtggagtcgggtgggggacggtcggttcggtccgacggtcccggtagggggtaccggtccccgtggtaaccgtaccttccgttacctggttaacgtacggtcccgttagtacgggtactttacccgtacccgttaccgaacggtaaccaaacgttaacggtcgggtacctagtcggtaacccgtacggggtttccgggggtccccgacccggtacggtccccgtacggggaaccgggacgggtaacgggggtcgtaggggcgggttaggggacggtacgtagtttaacgtacgtacgtaaggtaagtggtaaggttagggtaccggtttagggtacggtagggtaaggttagtcggaaccgtaaacgtccggttaaccgggtaacgggtaccggtacgtacgtaaccgaccgtacgtacgtacgtaacgaacgtaactaacgttaaccgaaacgaactaccgtacctacgttaaccactaacgaacgtaanacggtaaccgtataacgtaggaacttaggacgtaacggtaccgtaaggtccggtacgtacgtacgtcgtaccggtacggtacgtaaccggggaagggttacggtaagggtcgtaaggtaccgg

SEQ ID NO: 60496 - DNA, 885 bp, Homo sapiens
  misc_feature: GYAE6OF01BS7M4.37.8.A08.1.454.CMB.1.raw
  modified_base (176)..(176): a, c, t, g, unknown or other
  misc_feature (176)..(176): n is a, c, g, or t
tcagtagtgtagatcacgaccggtgctcgatttagcatactctacaggggctgggagaggagcccagcactagaagtcggcggtgtttccattcggtgatcggcactgaacacagaggactcacatggtagtttgggctgagtcgttgggtcttcctcgttgcttacgttttaagnggttgtccaggttgtcgtaggtgctaccgttgggtggtacggttcggtggggggacggtcggttcgggtccagggcccggttagggggaccggttcccgtaggaacgtaccgtttccgttaccgttaggttacgttacggtccccttacggtttaggtaaccttttccctaacccgtttaccgaacgaccgttaaaacgttagtcgggtacctaacggttcgtacccgttaccgggttcggggttccccgaccgtacgggtccccttaaccgggaacgggacgggtaaacggggggcgttacggggggagggtttccgggggtagtacggtttaagtttaacgtaacggttaccgtaaggttagtaccgggttaaaggtagggtttaaagggtttcgggttaaggaacggggttataaacggtcggtaaccggtacgggttaccggtacgggttaacggggtaacggtacccgttacttaacccgtacgtaccgttaccgtaaccgaagaaccgtaaacctaaccgtttaaaccgaaacgtaaacccgacgttaccgttaccttaagtccgtaactaacgtaaacgacgttaaacgcgttacgacgtaacggacgaaaccgtaggtaaccgaaccgtacgtacttaactggtacgtaggaagggacgtacggggttgggaacgggtggtaaccgggtcggtaccggggg

SEQ ID NO: 60497 - DNA, 667 bp, Homo sapiens
  misc_feature: GYAE6OF01B76RC.37.8.A08.1.454.CMB.1.raw
  modified_base (164)..(164): a, c, t, g, unknown or other
  misc_feature (164)..(164): n is a, c, g, or t
  modified_base (180)..(180): a, c, t, g, unknown or other
  misc_feature (180)..(180): n is a, c, g, or t
  modified_base (256)..(256): a, c, t, g, unknown or other
  misc_feature (256)..(256): n is a, c, g, or t
tcagtagtgtagatcacgaccggtgctcgatttagcatactctacagggctgggagaggagcccagcactagaagtcggcggtgtttccattcggtgatcggcactgaacacagagactcacatggagtttggctgagcgtgtcgtcgtaggtcgctagttagngtgcagtgcgagtcgngctggcgagtcgtgggcgagtcgccgaggccgtggacgtacctagacgcctcgtactgtaataccgccctcgtagntactactacgtacgacgtactacgtcgacgtagtacgacgtaccggtcggtaccgtaccgacgccgtaccgcggtacggaggtcggtaggtggtacggtggtagtagtaagtacgtagtagtagtagtagtagtagtgtagtagtagtagtacgacgtacgtacgtacggtcggtacgacgtacgtacgtacgtacgtaccgtaccgtaacgtaacgtaaccgtaaccgtaaccgtaaacgtaacctacctaccgtaccgttaccgtaaccgtacgtaactaacgtaaccgtaaccgtaaccgtaccgtaacgacgacgtaacgtaacgtaaccggtaccgtacgttacgtacgtacgtacgttacgtacggtaacggtaacggttaacggtaggttacggtacgtggtcg

SEQ ID NO: 60498 - DNA, 802 bp, Homo sapiens
  misc_feature: GYAE6OF01CJ3J8.37.8.A08.1.454.CMB.1.raw
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (184)..(184): a, c, t, g, unknown or other
  misc_feature (184)..(184): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
tcagtagtgtagatcacgaccggtgctcgatttagcatactctacaggggctgggagaggagcccagcactagaagtcggcggtgtttccattcggtgatcggcactgaacacagagactcacatggagttgggctgagtctgggtcttcctcgttgcttctttaagngtntccngtgcaggtncaccgtggtggatcggaggggngcgtggccngccgtgggcgtcctgacgctctctcgtancgtctatggtcttcaccttacagtaacctaacgtactcggactagtcgacctacgggttccgggcccgacccgaggtcccgtaccggacgggaacggaacgggggtcctagggggtcggttcggggttggaaccgtttaagggtattacggtacgtacggaagttttaggagggttagtaggttacgggtaggtaacggggtattacggtagaccgtaacgggtaccgttaacccggggtacggtaaccgggtccgtaacgtttaccccgacctaacggttacccgtacgaaacggggtaccgtaaacccttaacgtaacccaaaccgtaaacgtaacccgttaccccgttaagttaaccgttaagtaacccggaaaacttaacggtaccgtaacccggtacgtaaccggtagttaaccggaaggttacgggaaccggttccgtaaccgtacgggttacggtacggtttaacccgcggttttacggaaccccgggttacggtaaacccggggtttaaaggggggttacggggttaaaggtccggtaaacgggttccgg

SEQ ID NO: 60499 - DNA, 917 bp, Homo sapiens
  misc_feature: GYAE6OF01CRWYY.37.8.A08.1.454.CMB.1.raw
  modified_base (190)..(190): a, c, t, g, unknown or other
  misc_feature (190)..(190): n is a, c, g, or t
  modified_base (513)..(513): a, c, t, g, unknown or other
  misc_feature (513)..(513): n is a, c, g, or t
tcagtagtgtagatcacgaccggtgctcgatttagcatactctacgaggggctgggagaggagcccagcactagaaggtcggcggtgtttccattcggtgatcggcactagaacacaggaggactcaccatggagttgggctggagtcgttgggttccttcccttcggttcgtctttacgttttaaaggngggttcgtccgtaggtggtccgagggtcgccgtaccggtggggtaggtacggtccgggtagggggggacggtccgggtcggtcccggacggtccgggtcggggtaccggttccccgtaggacgtccgttccgttaccgtagttactaccggtaccttcggtacggttaccttccaacccgttacgacgacctaaaacgtgtacggtccctagtacgcccgttaccgggtcccgggggtacccgacccgtaccggggtaccctcggggaacgggaaccgggtgggggtcgtaggggtaggttcgggtgtaacgtagtataccgnggtagagtacgagttagggaaggttgggtagtaggtacgtagtcgacggtacggtaccgtacggggtacggtaccggtccgttacgtacccctaactccgtaaacccgtaccggaacgtaaacctaacccgttaaaccgtaaccctaaaacggtacccttaacccgtaaccctttacgtaaacgtaccttaacggtaaaaccccggtaagtaaacccgggtacttacggaaacccttacggtaaccggtaccgggtaaacgggtaaccccgaggtttaacccggggttgttaacccggggtattaacccccggttcgggtaaccggttaaacccggggttacgggtaaacccgggggtttacgggggggttaaacggggttagaacgggtttacccggtagggg

SEQ ID NO: 60500 - DNA, 698 bp, Homo sapiens
  misc_feature: GYAE6OF01CI3WX.37.8.A08.1.454.CMB.1.raw
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
  modified_base (654)..(654): a, c, t, g, unknown or other
  misc_feature (654)..(654): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatgggagtttgggctgagctgggtcttcctcgttgcttcttttaagnggtgtccagtgtcaggtgcacgtggnggtagtcgtggggagcgtgccagccgtgggagtcctgacgctcgtctgtatcgtcctgtggtcttccgtaaccttcagctaaaactgtggacatgaccgtacggtcgggtaccgccgtagggcctacccggaagggaccgggaaacggggtcttagggggtaacgggttgggggcgtacctaaaggtttaactaggttacaagggtactaagggtagttacggggtaaagtttgggtaagtaacgggagtttacgtggacgtaacgacccgttaggacggaagggtcctaacttcaaccgttactacctaacgaaagaacgtaactaaactttaccgaaaggtaacgttaacggtactaacgtacgtaaacggtaaactaacggaactaaccggtgtaggaacggtacggaccggacggtaaccgcccgtacctacttaacgttcgtacggtcggngaaacggaacgtacaacggacgggaagtaacggtacgtaggacg

SEQ ID NO: 60501 - DNA, 746 bp, Homo sapiens
  misc_feature: GYAE6OF01E4QZ4.37.8.A08.1.454.CMB.1.raw
  modified_base (578)..(578): a, c, t, g, unknown or other
  misc_feature (578)..(578): n is a, c, g, or t
  modified_base (637)..(637): a, c, t, g, unknown or other
  misc_feature (637)..(637): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtgggtcttcctgttgcttacttttaagaggtcgtccagtgtcgaggtgcaccgtgggtggagtcgtgggggaggtcgtggccaggccgtgggacggtcctgacgtacctctccgttagtatacgtccttgtcggtacttaccaccgtttacacgtaccaacgttagcggacagtcggacctaaccggttcggggtaccccgaccgacggtacccgttaccggaacggggaccggtaacgggggtcgtaggggtacggggtcggggttacggtacgttaacggtttaatacgtaacgtaaggtacgtaggtaacggttgggaaagtttcggttaagggagtaagttagagtacgaacgtaccgtacgggtaggaaccgggtctaaccgtctaaccctactaccgacgtaagaacgtacctaacgttacccgaaanaaccctactaacctatacttacgtacgaaacgtaacgtaccgaacgtaccgtcggtaanaacggtaacggtaacggaccgtacggaacgtcgtacggttacgtacgttacgacgtacggtacggtaaccgggtaacggggtttaacggggtaggtacgtagggtacgg

SEQ ID NO: 60502 - DNA, 739 bp, Homo sapiens
  misc_feature: GYAE6OF01C33OT.37.8.A08.1.454.CMB.1.raw
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (272)..(272): a, c, t, g, unknown or other
  misc_feature (272)..(272): n is a, c, g, or t
  modified_base (357)..(357): a, c, t, g, unknown or other
  misc_feature (357)..(357): n is a, c, g, or t
  modified_base (562)..(562): a, c, t, g, unknown or other
  misc_feature (562)..(562): n is a, c, g, or t
  modified_base (719)..(719): a, c, t, g, unknown or other
  misc_feature (719)..(719): n is a, c, g, or t
tcagtagtgtagatcacgaccggtgctcgatttagcatactctacaggggctgggagaggagcccagcactagaagtcggcggtgtttccattcggtgatcggcactgaacacagaggacctcaccatggtagtttggctgagctggtcttcctgttgcttgtttaagggtntcngtgtcaggtcnctaccgtgggtgagtcggtagggggagtccggtggtccaggtcccgtggggtcgtaccctggacacgttctccgtgtaatcgcctntggtctcctaccttacacgactaactgcggctactcgccgtcgtacgggtccccgcgtacggtccgtcgacggacggtaacgggnggtacggtggtcggggtagtacgtaaggttacttactacgtaagtagtagtaggaggttaacggttagggtaggtagggtagtacgacgacggtaccgtaccgttcgggtacggtaacgggtaccttaaccgttaccccgacgtaccctcggtaacccgaaggaacctactaaacgacctaaagaacctaccgtactcgttaacncgttaacgattaaacgacgtaaccggaccgtacgtaaacgaggtaaaccgtacgggttaccggacggtacggttccgtacggtttaaaccgcccggttaacttccgggttaaggttacccgggtaaaccgggtttaaaccgggtaaaccgggggttntaaaccggggtggtaccggg

SEQ ID NO: 60503 - DNA, 745 bp, Homo sapiens
  misc_feature: GYAE6OF01CD7FZ.37.8.A08.1.454.CMB.1.raw
  modified_base (507)..(507): a, c, t, g, unknown or other
  misc_feature (507)..(507): n is a, c, g, or t
  modified_base (614)..(614): a, c, t, g, unknown or other
  misc_feature (614)..(614): n is a, c, g, or t
tcagtagtgtagatcacgaccggtgctcgatttagcatactctacaggggctgggagaggagcccagcactagaagtcggcggtgtttccattcggtgatcggcactggaacacagaggacctcaccgagtggagtttgggcctgacgtcgtgggtcttcctcgtttggacttacgttttaaggaggttcgtacctaggttagtccgaggtcgcctaccgttgggtacgtacggtcggttaggggggacgtccgttggtaccaacggtccggtaggggtaccgtcccttaggaccgtacttccgtcgtacggtcgcgtaccgtccgttgtaggtacctttaccgtaccctttacggaagtacggtacttaacggacctagtaacgttacggaaccgttccgggggtacccacccgtaaggtccccgttaacggggaaggggtaacggtcgtaacggcggttccggtactacgtactaccgtagttacgtaggtacgtagttacctanacgtaacgtcctaagcgtataccgtaggacggtcgggacggtacctagtcctaacgtcgtacgaccgaggaaccctaacgaacctaacgtaacctacttcaacgttnaccgttacgacgtaacaacgtacgaaactcgaacgtaggactaccggacgaacgaccgtaggtctacgttagtaccgtttgacctagggaccacgtcccgacccctaggacctacggacgtccgaagtcgg

SEQ ID NO: 60504 - DNA, 702 bp, Homo sapiens
  misc_feature: GYAE6OF01D82OX.37.8.A08.1.454.CMB.1.raw
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (588)..(588): a, c, t, g, unknown or other
  misc_feature (588)..(588): n is a, c, g, or t
tcagtagtgtagatcacgaccggtgctcgatttagcatactctacgaggggctgggagaggagcccagcactagaagtcggcggtgtttccattcggtgatcggcactgaacacagaggactcacatggagtttggctgagctggtcttcctgttgcttctttaagnggtntcagtgtcaggtncacgtggtggagtcggnggggagcgtgtccaggccgtggggacgtcctgagtaccttctccgttagtacgtacgtccttcgtaggtaccttccgaacccttgaacgtaccctaagttcgtacggcctaagttcgacccgtaccgggttaccgggggtccccgaaccggtagggtccccctaaccgggacgggggaacgtaacggggggtcgttaggggtacgggttggggtacgtaccgttaagttacgtacgtacggtaggtagtacggaggttacggggtaagttcggttaaggaggtacgttcgaggacgtaacgtcgtaccggtaggaaccgtacgtactacaccgtactaccgacgacggtaactaactaacgtaccgaacgtaacacctattctactntaacgaacaagtacgaccgagtaccaggaacacgagacgacgtacggtcgtagtactacgtcgtacggtacgtaccggaaacggttacggggttaagggtgaagtcggtaacgg

SEQ ID NO: 60505 - DNA, 736 bp, Homo sapiens
  misc_feature: GYAE6OF01EB5J1.37.8.A08.1.454.CMB.1.raw
  modified_base (231)..(231): a, c, t, g, unknown or other
  misc_feature (231)..(231): n is a, c, g, or t
  modified_base (493)..(493): a, c, t, g, unknown or other
  misc_feature (493)..(493): n is a, c, g, or t
  modified_base (724)..(724): a, c, t, g, unknown or other
  misc_feature (724)..(724): n is a, c, g, or t
tcagtagtgtagatcacgaccggtgctcgatttagcatactctacgaggggctgggagaggacgcccagcactagaagtcggcggtgtttccattcggtgatcggcactgaacacagaggacctcaccagtgggagtttgggctggagtcgttgggtcttccgttcgttcgtacttcttttaagtggtcgtcctagtgtgaggtcgactacgtggtggagtcggtgggggngcgtcggtccacggccgtgggacgtacccgtgacgtccttcttcctagttatcgccttcgtaggttcttaccctacgttaccaaggtacctaatagtcggacctatcggacccgtacggttccggggtacccaccggtacggcccgtaccggacgggtacggaacgggggtcgttggggaggttcgggtagtacctagttaactacgtagaagtgtaaggcggttaagggtaaggttaggtaggtaaggtagggttaacccnggtaccggacgtaccggttacggtacgggtaccgggtaccgtacttaccgtaccgtaactccgtaagtacggtaactaacgtaaccgtaaacccaacgaacgtaccctattcccgtaactaccgtaagaaccgtaacgaagaccgagttacgaacgtacgaacgtacggacgcggtacgtgtacgtagtctcgtacggtcgaccggtaacggtaccgggtaggggtaacgnggtcggtaacgg

SEQ ID NO: 60506 - DNA, 493 bp, Homo sapiens
  misc_feature: GYAE6OF02IVD1I.37.8.A08.1.454.CMB.1.raw
  modified_base (334)..(334): a, c, t, g, unknown or other
  misc_feature (334)..(334): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctgggaggtccctgagactctcctgtatagcctctggattcaccttcagcaactatggcatgcactgggtccgccaggctccaggcaaggggctggagtgggtggcagttanatcagatgatggaagtgttgaggagtatgcagactccgtgaagggcgattcacatctccagagacaattccaagaacacactctatctgacaatgaacagcctgagaactgagacacggctgtagtatcatgtgcggaaccgaagggggtttgagtatg

SEQ ID NO: 60507 - DNA, 567 bp, Homo sapiens
  misc_feature: GYAE6OF02I1M4R.37.8.A08.1.454.CMB.1.raw
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtgtcctaggtgctctttaagagtgtccagtgtcaggtgcacctggtgagtctggggagcgtggtccagctgggaggtccctgagctctcctgtatgctctggattcaccttcagcaatntggcatgcnctgggtccaccgngctcgagcgaggctggngtggtgngtagtagtatcgagagtagagtagtagtgtaggtagagtagtgacgagtacgtacgtagacggacgtacgtactactactacgtacgagacgtactaactaacgaacgaacactactactactactacgtactaacgtaacgaacgtacgtacgtacgtaacgtaacgtacgacgacgtacggtacggtacgtacgtacgtacgtacgtacgtacggtaccggtaaccggtaacggggttaggtacggtagtacg

SEQ ID NO: 60508 - DNA, 507 bp, Homo sapiens
  misc_feature: GYAE6OF02F6X5K.37.8.A08.1.454.CMB.1.raw
  modified_base (332)..(332): a, c, t, g, unknown or other
  misc_feature (332)..(332): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggaggtccctgagactctcctgtatagcctctggattcaccttcagcaactatggcatgcactgggtccgcaggctccaggcaaggggctggagtgggtggcagttanatcagatgatggaagtgtgagagtatgcagactcgtgaagggccgatcaccatctcagagacaattacaagaacacactactatctgacaatgaacagacctagacgaactagagacacggctggtatactcacgtgtacgaccgtaaccggtaagggggtttggagtagtacgg

SEQ ID NO: 60509 - DNA, 544 bp, Homo sapiens
  misc_feature: GYAE6OF02IHU99.37.8.A08.1.454.CMB.1.raw
  modified_base (255)..(255): a, c, t, g, unknown or other
  misc_feature (255)..(255): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (441)..(441): a, c, t, g, unknown or other
  misc_feature (441)..(441): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggaggtccctgagactctcctgtatagcctntggattcaccttcagcaactatggcatgcactggggtccgccgaggcctccgaggcgaaagggggctgggacgtggggtggctaggttaatatcagatgatggaagtgttgaggagtatgcagctcgtgaagggcatcacntcncaganacaattcaagacacactctatctgacaaatagaaacngaccttaggaacgtaaacgtgaacggacaacgggtctggtagtacttccgacgttaggtacggaaccggtaaccggttaaggggggtttcgaaggtagtacgg

SEQ ID NO: 60510 - DNA, 631 bp, Homo sapiens
  misc_feature: GYAE6OF02IS0P7.37.8.A08.1.454.CMB.1.raw
  modified_base (171)..(171): a, c, t, g, unknown or other
  misc_feature (171)..(171): n is a, c, g, or t
  modified_base (263)..(263): a, c, t, g, unknown or other
  misc_feature (263)..(263): n is a, c, g, or t
  modified_base (519)..(519): a, c, t, g, unknown or other
  misc_feature (519)..(519): n is a, c, g, or t
  modified_base (539)..(539): a, c, t, g, unknown or other
  misc_feature (539)..(539): n is a, c, g, or t
  modified_base (572)..(572): a, c, t, g, unknown or other
  misc_feature (572)..(572): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtcttcctcgttgcttcttttaagnggtgtccagtgtcgaggtgccaccgtggtggagtcgtgggggagcgtggtccagccgtgggacgtccctgacgactctccgtgtgtagcctntagtaactttccccgttaggctttagtggattggagtcgtcggggtcccgccgaggtcctccggaagggggaacggggtcgtggggaggttgggggtcggacccaaacgtaagtaaaacggcaaaggagtagggaaagtaaaggaagggattagtggtaggacttcgtggtaggaacgggtccgtttacgacctatcctaccgagacgaacaaccgaccgaaagaaccctcgtagacactctgaacaagtcgaacngtctagagacgaccgagacncggtacttatttatacgtgcgagagagaacggngttcgggtcggttacacgttaggtcgggaccgtaacgggaccctggtaccgaccgtccg

SEQ ID NO: 60511 - DNA, 524 bp, Homo sapiens
  misc_feature: GYAE6OF02HG39S.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagtaggtgtccagtgtcaggtgcacctggtggagtcgtgggggagggcgtggtccagccgtgggaggtccctgagactctcctgtgcagcctctggattcaactttggtagctattggatggactgggtcgccagtctccagggaagggctggagtgggtgccaacatacagggaggtggtggtaacgaaaaactatgtaggactctggtgcggggccgattcacatctcagagacaacgaccaaaactcactgtatcgtgacaaatggacggcctgagacgccgaggacacggctgtgtattattgtgcgagagtatttagactagtaaagttcgagtgacgtgtagtagatgtac

SEQ ID NO: 60512 - DNA, 516 bp, Homo sapiens
  misc_feature: GYAE6OF02FU6C7.37.8.A08.1.454.CMB.1.raw
  modified_base (297)..(297): a, c, t, g, unknown or other
  misc_feature (297)..(297): n is a, c, g, or t
  modified_base (437)..(437): a, c, t, g, unknown or other
  misc_feature (437)..(437): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctgggaggtcccctgagactctcctgtatagcctctggattcaccttcagcaactatggcatgcactggggtccnccaggctccgaggcaaggggctgggagtgggtggcagttatatcagatgatggaagtgtgaggagtatgcagactcgtgagggcgattcacatctccagagacaattaccaagaacacactgtctctgacaaatgaaacngcctagagagtcgaggacacggtaccttaatattactgtagtaggacgggtacctccgtacgtccccttagtacgtacg

SEQ ID NO: 60513 - DNA, 534 bp, Homo sapiens
  misc_feature: GYAE6OF02HDTIR.37.8.A08.1.454.CMB.1.raw
  modified_base (395)..(395): a, c, t, g, unknown or other
  misc_feature (395)..(395): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggaggtccctgagactctcctgtatagcctctggattcaccttcagcaactatggcatgcacgtggggtccgccaggcctccgaggcaaggggctgggagtggggtgctagttatatcagatgatggaagtggtagaggtagtatgcagactcgtagaggccatcacatcncagagacaattaccaagaacacactactatctagacaaatgaacacgacctagaacgaacgtgaacggacgacggtacgtggtacgtactcgtacgtgtacgaccggtaaccggtaagggggtttacgaggtagtacgg

SEQ ID NO: 60514 - DNA, 552 bp, Homo sapiens
  misc_feature: GYAE6OF02GJCP5.37.8.A08.1.454.CMB.1.raw
  modified_base (276)..(276): a, c, t, g, unknown or other
  misc_feature (276)..(276): n is a, c, g, or t
  modified_base (339)..(339): a, c, t, g, unknown or other
  misc_feature (339)..(339): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggaggtccctgagactctcctgtatagcctctggattcaccttcagcaactntggcatgcacgtggggtccgccaggcctccgaggcaaggggctgggagtgggtggctagttanatcagatgatgggaagtgttagaggagtatgcagactcgtgaagggccgattcacatctccagacgacaacttaccaagaacacactctatctagacaatagaacacgacctagaacgaacgtagaacggacgacggcgtaggtacgtacgtcctacgttggtacggtaccggtaaacccgggttaaggggggttttacggaaggtagtacgg

SEQ ID NO: 60515 - DNA, 589 bp, Homo sapiens
  misc_feature: GYAE6OF02HNSLE.37.8.A08.1.454.CMB.1.raw
  modified_base (299)..(299): a, c, t, g, unknown or other
  misc_feature (299)..(299): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggacgtccctgagactctcctgtatagcctctggattcaccttcagcaactatggcatgcacgtgggtcccncaggctccgaggcgaaggggctgggagtgggtgctagttatatcagatgatgggaagttgtaggaggtagtatgacagtaccgtcggtaggaacgggccgtattccaacctatcctaccgagaacgaactaacttaccaaacgaacaactactactactctacgaactaaagtacgaaacacgtaccgtaagaacgaaacgtaggacggacgacggtacgtcggtacgttactacctacgtggtacggaaccggtaaaccgggttaagggggtttacggaggtagtacgg

SEQ ID NO: 60516 - DNA, 558 bp, Homo sapiens
  misc_feature: GYAE6OF02F3NFW.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttggggctgagctgggtcttcctcgttgctcttttaagaggtgtccagtgtcaggtgcacctggtggagtctgggggaggcgtggtccagcctggggaggtcccctgagactctcctgtatagcctctggattcaccttcagcaactatggcatgcactgggtccgccaggctccaggcaaggggctgggagtggggtggcagttatatcagatgatggaagtgttgaggagtatgcagactccggtgaagggccgattcaccatcctaccagaacgacaacttaccaagtaaccaacactactatctagacaaatgaaacacgacctagaacaacgtaggaaggaccgacggtctaggtacgttactaccgtacgtggtacggaccggtaaacccggtaaggggggttttacggaggtagtacgg

SEQ ID NO: 60517 - DNA, 532 bp, Homo sapiens
  misc_feature: GYAE6OF02I67OE.37.8.A08.1.454.CMB.1.raw
  modified_base (336)..(336): a, c, t, g, unknown or other
  misc_feature (336)..(336): n is a, c, g, or t
  modified_base (392)..(392): a, c, t, g, unknown or other
  misc_feature (392)..(392): n is a, c, g, or t
  modified_base (421)..(421): a, c, t, g, unknown or other
  misc_feature (421)..(421): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggaggtccctgagactctcctgtatagcctctggattcaccttcagcaactatggcatgcactggggtcccgccaggcctccgaggcaaggggctggagtgggtgcagttanatcagatgatgggaagtgttagaggagtatgcagactcgtgaaggccatcacatcncagagacaattcaagacacactctatctnacaaatgaacagcctagaacgaacgtaggaacggaccacggtcgtaggtagttactacctacgttaggtcggaccggtaaaccggtaaggggggtttcggaaggagtacgg

SEQ ID NO: 60518 - DNA, 506 bp, Homo sapiens
  misc_feature: GYAE6OF02H7EPK.37.8.A08.1.454.CMB.1.raw
  modified_base (335)..(335): a, c, t, g, unknown or other
  misc_feature (335)..(335): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctggggaggtccctgagactctcctgtatagcctctggattcaccttcagcaactatggcatgcactgggtccgccaggctccaggcaaggggctggagtgggtggcagttanatcagatgatggaagtgttgaggagtatgcagactccgtgagggccgattcacatctcagagacaattccaagaacacactctatctgacaatagaacagcctgagaactgagacacggctggtagtatacactgtacgacggaaccgtaagggggtttggaggtagtcgg

SEQ ID NO: 60519 - DNA, 576 bp, Homo sapiens
  misc_feature: GYAE6OF02IAC4V.37.8.A08.1.454.CMB.1.raw
  modified_base (426)..(426): a, c, t, g, unknown or other
  misc_feature (426)..(426): n is a, c, g, or t
tcagtagtgtagatcacgaccggtgctcgatttagcatactctacaggggctgggagaggagccccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggaggtcccctgagacctctcctgtatagcctctggattcaccttcagcaactatggcatgcacgtcggggtcccgccagggcctccgagggccaagggggctgggaggtggggtggcagttatatcagatgatgggaagttggtagaggatatgacagaccgtcggtagaacgggccgattccacctatctccaganactaacttaccaagaacactactctatctagactaatacgaacacgacctagaacgaacgtaggaacggacgacggtcgtggtagtactacctacgttaggtacgaaccgggtaaaccgggttaaggggggtttacggtaggtagtacgg

SEQ ID NO: 60520 - DNA, 527 bp, Homo sapiens
  misc_feature: GYAE6OF02H00R2.37.8.A08.1.454.CMB.1.raw
  modified_base (336)..(336): a, c, t, g, unknown or other
  misc_feature (336)..(336): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctgggaggtccctgagactctcctgtatagcctctggattcaccttcagcaactatggcatgcactgggtccgccaggcctccaggcaaggggctggagtgggtggcagttanatcagatgatggaagtgtgaggagtatgcagactcgtaggagggccattcacatcacagagactaagttccaagaacacactctactctagacaatcgaaacagacctagacgtaactggaacggacacggcgtaggtgtactcgtacgttaggtcgacggtaaccggtaagggggtttcgaggtgtacgg

SEQ ID NO: 60521 - DNA, 566 bp, Homo sapiens
  misc_feature: GYAE6OF02IZ02E.37.8.A08.1.454.CMB.1.raw
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagccgtgggacgtccctgagactctcctgtatagcctctggattcaccttcagcaactatggcatgcactgggtccncaggcctccgaggcgaaggggctgggagtgggtgcagttanatcgagatgagtggaagttgttaggaggtagtagtgacagtaccgtccggtaggaacgggtccgaattccgaaccatcctaccgaagacgaactaattaccgaaagaaccacacctctatctgacaaatagaacacgacctagaacgaacgtgacggtacgacggacgttgtacgtactacacgtcgtacgaccggtaaaccggtagggggtttacgaggtatacggg

SEQ ID NO: 60522 - DNA, 661 bp, Homo sapiens
  misc_feature: GYAE6OF02GJ67E.37.8.A08.1.454.CMB.1.raw
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggagcgtggtccagcctgggagtccctgagactctcctgtatagcctctggattccaccttcagcaactatggcatgcacgtgggtccgccaggcctccgaggcaaggggctgggagtgggtgctaggttatacgtcgagtactgatagggtaagttggttaggaggtagtatggactaggtaccgtccggtagaacgggtccgtacgtttaccgacgtactccgtaccgaaggtaacgtaaccgtaaacgttaccgaaacggtaaacctaaccgtaacctacgttaactaccgtagtaaccgaaaagttcgaaacgtacgtacccgtaagaacggtaaacgttacgggaacgggaaccgtaccgggtacgttagggttacgttaactaccgtacgttacggtccggaaccggttaaacccgggtagggggtttacggaacggtgtaaccggg

SEQ ID NO: 60523 - DNA, 611 bp, Homo sapiens
  misc_feature: GYAE6OF02I9EXH.37.8.A08.1.454.CMB.1.raw
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggagcgtggtccagccgtgggacgtccctggagactctcctgtatacgcctgtggacttcaccttcagaccaactagtcggactagtcgaccacgttcggggtcccgccagggcctaccggaggcgaaggggctagggaggtgggtagctagttanatcagtntgagtggagtgtagaggtagtatgacacgtacgtccgtaggaacgggtccgtacttacgaacctattccgtaccgaaggaaccgaactaaacgttaaccgaaacgaacaacctacctactagttactagaacctaaagtacgaacacgtaccgtagaaacgtaacgtaggagaccgacggtcgttagtacgtactcgtacgtaggtacgaacggtaaccggtaggggttagacgtagtcgg

SEQ ID NO: 60524 - DNA, 585 bp, Homo sapiens
  misc_feature: GYAE6OF02FIO6F.37.8.A08.1.454.CMB.1.raw
  modified_base (380)..(380): a, c, t, g, unknown or other
  misc_feature (380)..(380): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagccgtgggaggtcccctgagactctcctgtatagcctctggattccacttcagcaactatggcatgcacgtggggtcccgccgaggcctccgagggcgaaggggctgggaggtgggtggctagttatatcgagatgataggaagtgttagaggtagtangcagctccggtaggagggccgatccgaccatccgtaccagaacgactaacttaccaacgaaccacactactactactagaactaagtacgaacacgacctagaacgtaacgtacgggaagaccgacggtccgttaggtacgtaactccgtaacgttggtaccggaaccggttaaaccgggtacgggggtttggaacgtagtacgg

SEQ ID NO: 60525 - DNA, 516 bp, Homo sapiens
  misc_feature: GYAE6OF02HQ4PC.37.8.A08.1.454.CMB.1.raw
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
  modified_base (397)..(397): a, c, t, g, unknown or other
  misc_feature (397)..(397): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagccgtggggaggtccctgagactctcctgtatgcctctggattcaccttcagcaactatggcatgcactgggtccncaggctccaggcaaggggctgggagtgggtgcagttanatcagatgatggaagtgtgaggtagtatgcagctcgtgacggcgatcacatctacagacganaactcaagaacacactctatctagacaatagaacagacctagaacgaacgtagacggacacggcgtagtgtatctactggtacggacggtaaccggtaaggggtttaggagtagtacgg

SEQ ID NO: 60526 - DNA, 692 bp, Homo sapiens
  misc_feature: GYAE6OF02G42UB.37.8.A08.1.454.CMB.1.raw
  modified_base (171)..(171): a, c, t, g, unknown or other
  misc_feature (171)..(171): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagnggtgtccagtgtcaggtgcacctggtggagtcgtgggggaggcgtggtccagccgtggggacgtccctgagactctcctgtatacgcctctggattcaccttcagcaactntggcatgcacgtgggtccnctaggcctcgaggcgaagggctagggagtgggtgcgtaggttatagtcgagatgaagttgggaagttggttaggaaggtacgttagtggacgaggtaccgtccggtagggaacgggtaccgtacttaccgaaccgtacgttccgtaccgaacggtaacgtaacctaaacgtttaacccgaaaacggtaaaccctaaccgtaaccgttaaccttacgttaccgtaaccgaaaccgtaaacgtaacgaaaccgtacgtaccgtaacggaaactaacggtaacggaaccgggtaccgaccggtacggttagttacggttaacgtaccgtagttcggtaaccggtaaccgggtaaaccgggttaaggggggtttaacggtacggtacgtaacggg

SEQ ID NO: 60527 - DNA, 553 bp, Homo sapiens
  misc_feature: GYAE6OF02FLFPG.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctgggaggtccctgagactctcctgtatagcctctggattcaccttcagcaactatggcatgcactgggtccgccaggctccaggcaaggggctgggagtgggtggctagttatatcagatgatggaagtgttgaggagtagtgcagactcgtgaagggccgattcacctatctcagagacaattccaagaacaccactactatctagacaagtacgaaacacgaccctagaacgtaaacgtaggacggacgacggacgttggttacgtacgtaccgtagtacggtacggaccgtaaaccgggtaagggggtttacggaaggtagtacggg

SEQ ID NO: 60528 - DNA, 559 bp, Homo sapiens
  misc_feature: GYAE6OF02HVBH8.37.8.A08.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
  modified_base (412)..(412): a, c, t, g, unknown or other
  misc_feature (412)..(412): n is a, c, g, or t
  modified_base (449)..(449): a, c, t, g, unknown or other
  misc_feature (449)..(449): n is a, c, g, or t
  modified_base (499)..(499): a, c, t, g, unknown or other
  misc_feature (499)..(499): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtgggtccagccgtggggaggtccctggagactctcctaggtatacgcctntggattcaccttnagcaactatggcatgcacgtcgggtccnccaggctccgaggcaaggggtctggagtcgggtgctaggttatancgagatgactaggaagtgttaggagggatagtcgnaggactccgtagaacggcgatcgactanctacagagactaagttaccaagaacacactctactcncgtaacaatcgaaactcgaccgtgaaacgaactaggaacgtacgacggtnacggttagactactacgtggtacacgggtaaccggtaagggggtttcgacggtagtacgg

SEQ ID NO: 60529 - DNA, 689 bp, Homo sapiens
  misc_feature: GYAE6OF02IJA2Y.37.8.A08.1.454.CMB.1.raw
  modified_base (300)..(300): a, c, t, g, unknown or other
  misc_feature (300)..(300): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggacggtccctgagactctcctgtatacgcctctggattcaccttcagcaactatggcatgcacgtgggtcccnccagggctccgaggcgaaggggctgggaggtgggtgctagttatatcagatgatgggaagttggttagaggtagttagtggctaaggtaccgtcgggtaggaacggggtcccgtagtttaccgaacccgtattcccgtaccgtaaggtaacgaaactaaaccgtttaacccgaaaagaaacccgaacctaaccgttacctaacgttacgtacgtaactaaaacgtacggtaaacctacggtaccctaggtaaacggaaaccgttagggaaccggaccggtaaccgggtcgttacggtaccgttaacgttaccgtaaccgttgggtaccggtaaacccgggttaacccggggtttaaagggggggttttacggacggttacggtaccggg

SEQ ID NO: 60530 - DNA, 785 bp, Homo sapiens
  misc_feature: GYAE6OF02FYDP0.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggagtccctgagactctcctgtatagcctctggattcaccttcagcaactatggcatgcacgtgggtccgccaggcctccgagggccgaaagggggtcctaggggtaggttgggggtagggaccgtaaggttttaagtaagttccgaagggtacttggaagttggggtaaaggttggtttagggaaggggtaaggttaactggaccgtaacgggtaccgttcccgggtacgggtaaacggggtcccgtaacgtttacccgaacccgtaacgttacccgttacccgtaacggaacggtaacccgtaaaacgtttaccccgaaaacgtaaacccgaacctaacccttaccgttaaccgttacccgttaacgtaaccgtaaaacgttaaccgaaaccgtaaccggttacccgtaacggtaaacggaaaccgttacgggaacgggtaacccgtaccgggtacggttacggttacgttaacgtacccggttacgttacgggttacggtacccgggtaaaacccggggtttaagggggggtttaacggtacgggtaagtaacccggg

SEQ ID NO: 60531 - DNA, 551 bp, Homo sapiens
  misc_feature: GYAE6OF02HB2XM.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggaggtccctgagactctcctgtatagcctctggattcaccttcagcaactatggcatgcacgtgggtccgccaggctccgaggcgaaggggctgggagtggggtggcaggttatatcagatgatggaagtgttagaggtagtagtgcaggtactccggtaggaagggccgattcaccatctcagagacaattaccaagaacacactctatctacgacaagtacgaacacgacctagacgaacgtagacggacgacgggactggtacgttactcgtacgttggtacgaccggtaaccggtaaggggggttacggtaggtagtcgg

SEQ ID NO: 60532 - DNA, 615 bp, Homo sapiens
  misc_feature: GYAE6OF02HE6WU.37.8.A08.1.454.CMB.1.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggaggtccctgagactctcctgtatagcctctggtattcaccttcagcaactatggcatgcacgtgggtccnccaggcctccgaggcgaaggggctgggaggtgggtggctaggttanagtcagatggatgggaagttgttaggaggtagtatgacagaccgtcggtaggaacgggccgtattccaccgtactctaccgaggacgaactaattacccaaagaaccaactacctactaactctacgtaacaaagttacgaaacacgtaccgttaggaaacgtaaaccgtaggaacgggaccgtaccggaccgttaggtacggttaactaccgtaacgttggtacggaccggtaaaccgggttaaggggggtttacggaggtagtaccggg

SEQ ID NO: 60533 - DNA, 600 bp, Homo sapiens
  misc_feature: GYAE6OF02G1TS8.37.8.A08.1.454.CMB.1.raw
  modified_base (299)..(299): a, c, t, g, unknown or other
  misc_feature (299)..(299): n is a, c, g, or t
  modified_base (346)..(346): a, c, t, g, unknown or other
  misc_feature (346)..(346): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggaggtccctgagactctcctgtatagcctctggattcaccttcagcaactatggcatgcacgtgggtcccncaggcctccgaggcgaaggggctgggagtgggtgcagttatatcagntgatagggaagttggttaggaggtagtatggacaggtaccgtcggtaggaacgggccgtattccaccatctaccgagacgaactaacttaccaaacgaaccacgtaacctactaatcgtaacgaactaaagtacgaaaccgtacgaccgtaacggaacgtaaacgtacggaacggtaccgacggtcgtaggtacggtactacgtacgtggtacggacccggtaaaccgggtagggggtttacggagtagtacgg

SEQ ID NO: 60534 - DNA, 678 bp, Homo sapiens
  misc_feature: GYAE6OF02FZIRZ.37.8.A08.1.454.CMB.1.raw
  modified_base (302)..(302): a, c, t, g, unknown or other
  misc_feature (302)..(302): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctgggtggagtcgtggggggaggcgtggtccaggcctggggacggtccctgagactctcctgtatagcctctggattcaccttcagcaactatggcatgcacgtgggtccnccaggcctccgaggcgaaggggctagggaggtggggtcggctaagttatactcgaagtatggaagtgggaaagttggttaggaaggtagttaatcggactaggtaaccgttccggtagggaaaccggggtcccgtaactttacccgaacccgtacttcccgtaacccgaaggtaaccgaaccgttaaacttaccccgaaaggtaaacccaaccgtaaccttaccttaactaccgtacggaacctaaaacgtaacgaaacgtacgtacccgtaacggaacgtaacgtagggaacggtacgacgggtcgttaggtacgttataccgtacgtacggtcgtaaccggtaaccgggttaagggggtttgacggtagtacgg

SEQ ID NO: 60535 - DNA, 550 bp, Homo sapiens
  misc_feature: GYAE6OF02GTNXO.37.8.A08.1.454.CMB.1.raw
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcccgtggggaggtcccctgagactctcctgtatagcctctggattcaccttcagcaactatggcatgccacgtgggtcccnccaggcctccgaggcgaaggggctgggagtgggnggctagttatatcagatggatggaagtgtagaggtagtntgcagacgtcgagaacggcgtatcactatctacagacgactattaccgaanaacacgtactactactctacgactaagtacgaacacgcgtagacgtaacgtaggacgacgacgtacgtgtacgtacgtcacgtgacgtaccggtaacgggtaaggggttaggacggagtacgg

SEQ ID NO: 60536 - DNA, 626 bp, Homo sapiens
  misc_feature: GYAE6OF02JHF7O.37.8.A08.1.454.CMB.1.raw
  modified_base (170)..(170): a, c, t, g, unknown or other
  misc_feature (170)..(170): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttctttaagnggtgtccagtgtcaggtgcacctggtggagtcgtggggagtcgtggtccagccgtgggagtccctgacgctctcctgtatagcctgtggattcaccttnagcaactntggcatgcctactgggtccacacggctccgaggccgaaggggctagggagtggggtcgcctaagttgtactcgagaacttgaacgtgggtaaagttggtaggaaggtatacgtgacgtaagaccttccggtaggaacggcgtaacttccaaccgactcgtaccaaggtacacgtaaattaaccgaaagaacctacgtaactacttaactctacggtaacctaagtacgaaacgtacgtaaccgtacgaaacgtaacgtaggtaacggacgtaacggtcgttacggtagtaactcgtaacgtaggtaccgtaacggaaccggttaagggggtttacgaggtacgtaacgg

SEQ ID NO: 60537 - DNA, 786 bp, Homo sapiens
  misc_feature: GYAE6OF02FY3YF.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatgggagtttgggctgagctgggtcttcctcgttgctcttttaagaggtgtccagtgtcaggtgcacctggtggagtcgtgggggaggcgtggtccagcctggggacggtccctggagactctcctgtatagcctctggattcaccttcagcaactatggcatgcactgggtccgccgaggcctccgaggcaaggggctgggagtgggtggcgtagttatatacagtatgagtgggtaagtggtttaggaagggtacgttaatggtaccgtaaggtaccgtcccgggttagggaaacggggtcccggtaactttaccgaacccgtattacccgtacccaaggtaacggaaccgttaaacgttacccgaaaacgtaaaccgtaaaccctaacctttacccgttaagttacccgttaacggtaaaccgttaaaacgtaccgtaaaacccggtaacggttaccgttaaccgggtaaaacggttaaacccgttaacggggaaaccgggtaacccggtaacccggggtaccggtttacgggttaaccggtttaacgttaacccggtaacggtttaccgggttaaacggggtaaccccggttaaaaacccggggggtttaacggggggggtttttaacgggaaacggggtaaaccggttaccggggg

SEQ ID NO: 60538 - DNA, 632 bp, Homo sapiens
  misc_feature: GYAE6OF02HMOT2.37.8.A08.1.454.CMB.1.raw
  modified_base (346)..(346): a, c, t, g, unknown or other
  misc_feature (346)..(346): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggaggtccctgagactcgtcctgtatagcctctggattcaccttcagcaactatcggcatgacacgttcgggtcccgccagggcctccgagggtccgaaggggcgtgggaggttggggnggcgtagttatatcgagtatagagtgggtaagttggttaggagggtagtagtgacgtagaccgttccggtagggaacgggccgtaacttaccgaacctatccgtaccgtaagacggaactaacgttaaccgaaacgaaaccaaccgtactacttactacgtagaacctaatacgaaacacgtaccgtagaacgaacgtagacggacgacggtacgttggtacgtacgtcctacgttaggtacggtaaccggtaaaccggttaggggggtttacggtaggtagtcgg

SEQ ID NO: 60539 - DNA, 664 bp, Homo sapiens
  misc_feature: GYAE6OF02I9JG2.37.8.A08.1.454.CMB.1.raw
  modified_base (201)..(201): a, c, t, g, unknown or other
  misc_feature (201)..(201): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
tcagtagtgtagatcacgaccggtgctcgatttagcatactctacaacgtacgacgaaaggggcgtgagagaggagccgttagccctggattccaaggccctatccacttggtgactccagcactgagcaccgaggattcaccatggactgggctccgctggtttcctagtgctactttagaggtgtccagtgtcgaggtncgagctggtggagtcgtgggggagtccgtgggtacaagccgtggggactccccgtagacgactctcctggtagcagtcctagtggattccaccgttgacgttagctatagtcgatgaacgttgggacccacgaggtcctaccggaaggggtacgggctaggggagtcgggtctacgactcgtaagtttgtagtaggtgtaacctagataactacgancgtagctacgngacgagggcatcgacagtcacgaganaccgtaacgacctaagactactacgtagttactcgaacgtacctaaaagtaccggaaacctactacggtacgaaacgggtaccgggttacccggacggggtaaaccggtaacccggggtcttaacggttaccggtttaaacttccggtttacgggaactccggggaaaacccggtttccgaaacccccgttcccggtaacccgttcccg

SEQ ID NO: 60540 - DNA, 611 bp, Homo sapiens
  misc_feature: GYAE6OF02JM1C5.37.8.A08.1.454.CMB.1.raw
  modified_base (254)..(254): a, c, t, g, unknown or other
  misc_feature (254)..(254): n is a, c, g, or t
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcactggtggagtctgggggagcgtggtccagcctggggaggtccctgagctctcctgtatgccttntggacttcgaccttcagtacaactatggcagtgcacgtcgggtccgccaggcctccgaggccgaaggggctgggagtgggtagcgtagttatntcgagtactgagtgggaattgggtagagggtatagngaccgagtcctccggtaggacgggtacctagtacctaccgtatccgtacgaggaacacgtaagttaccaaacgtaacctaccaccgttactactcgtagacctaagtacgaactagacctagaactaacgtgaacgtacgtacggtcgtacggttagtaacgtacgtacggttaggtacccggaaccgggttaaccgggttaagggggttacggtacgtaggtaacgg

SEQ ID NO: 60541 - DNA, 653 bp, Homo sapiens
  misc_feature: GYAE6OF02IEWU5.37.8.A08.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcaccgtggtggagtcgtgggggaggcgtggtccagcctgggaggtccctgagactctctgtatcgcctntggattcaccttnagcaactatggcatgcacgtgggtccnccaggctccgaggcgaaggggctgggagtgggtgctagttanagtcagtatgagtggtaagttgttagaggtagtatggacaggtaccgtccggtaggaacgggccgtaacttaccgaacctacttcctacgaagacgtaacctaaacgttacccaaagtaacaaccgtaacttacgtacttaccgtacgaactaaacgtacgaaaccgtacggtaccctaggaaacgtaaccgttaacgggaacgggaaccgaccgggtaccgttacggtacgttacgtaccgttaccggttaggtaccgggtaaccgggtaaacccggggttaaggggggtttacggtacggtaggtaaccggg

SEQ ID NO: 60542 - DNA, 553 bp, Homo sapiens
  misc_feature: GYAE6OF02GN557.37.8.A08.1.454.CMB.1.raw
  modified_base (276)..(276): a, c, t, g, unknown or other
  misc_feature (276)..(276): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggagcgtggtccagcctgggaggtccctgagactctcctgtatagcctctggattcaccttcagcaactntggcatgcacgtgggtcccgccaggcctccagggccgaaggggctgggagtgggtgcagttanatcagatgatggaagtgtaggaggtatangcagactcgngaggcatcacactcncgagagacaattacaacgaacacactctatcgtagacaatgaaacagaccgtagacgaaacgtgaacggaccgaacggtcgtaggtacgtactaccgtacgttacggtacggaccggtaaacccgggttaagggggtttacgggttaaggtaggtacggg

SEQ ID NO: 60543 - DNA, 500 bp, Homo sapiens
  misc_feature: GYAE6OF02GIF0L.37.8.A08.1.454.CMB.1.raw
  modified_base (335)..(335): a, c, t, g, unknown or other
  misc_feature (335)..(335): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctgggaggtccctgagactctcctgtatagcctctggattcaccttcagcaactatggcatgcactgggtccgccaggctccaggcaaggggctgggagtgggtggcagttanatcagatgatggaagtgtgaggagtatgcagactcgtgaagggcattcacatctcagagacaattccaagaacacactctatctagacaaatgaacagcctagagaactgacggacacggtctgtagtactcactgacgcgtaaccgtaggggtttcgagatcgg

SEQ ID NO: 60544 - DNA, 630 bp, Homo sapiens
  misc_feature: GYAE6OF02H102T.37.8.A08.1.454.CMB.1.raw
  modified_base (258)..(258): a, c, t, g, unknown or other
  misc_feature (258)..(258): n is a, c, g, or t
  modified_base (354)..(354): a, c, t, g, unknown or other
  misc_feature (354)..(354): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcacctggtggagtcgtgggggagcgtggtccagccgtgggagtcctgacgactctcctgtatagcctntggattcaccttcagcaactatggcatcgactacgtcgggtcccgccgagggcctccgaggcgaagggggctgggtaggtggggtggcgtagttanagtcgagtatgagtggaagttggtaggaggtagtgtgacagtaccgttcggtaggaacgggtccgtacgttaccgaaccgtacttccgtaccgaagaacgaacttaacttaaccgaaagtaacgttaaccggtcttaactaccgttaagaaatacggaacacgtacctagacgacggaccggaacggacgaccccggtaccttacgttacgtttaaccgtcggtacggtacgaacggagtacgacgaacgggtaacgggtaacgttacgaggtacg

SEQ ID NO: 60545 - DNA, 756 bp, Homo sapiens
  misc_feature: GYAE6OF02I3I57.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgtgctcttttaagaggtgtccagtgtcaggtgcacctggtggagtcgtgggggagcggtggtccagcctgggaggtccctgagactctcctgtactagcctctggattcaccttcagcaactagtggcatcgcacgtggggtcccgaccgaggcctacccgagggcgaacgggggctaggggaggtggggtcggacgtaaggttactagtcgaagtataggagtagggtaaggttaggttagggaaggtagtaagtcggaccgaacggtaccgtaccgggtaacgggaaccggggtacccgtaacttaccccgaaccgtaacgtacccgtacccgaaaggtaaccgaaaccttaaacgttaacccgaaaacgtaaacccaaccgtaacccgttacctaaaccgttcgttaacggaaacctaaaacgttacgaaacgtaaccggtaccctaagggaaaccggtaaacggtaaccggtaacgggaccgtaaccgggtaccgtttaggggttaaccctaagtacccggttaaggtccgggttaacggaaccgggggttaaaacccggggtttaagggggggtttaacggaggtacggtaccggg

SEQ ID NO: 60546 - DNA, 717 bp, Homo sapiens
  misc_feature: GYAE6OF02I55EC.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccattgtcaggtgcacctggtgagtcgtgggggagcgtggtccagccgtgggacgtccctggagacctctccgtgtcgcagcctctggttcattcttagcaacgtacgcctatgacgtcgtggggtcccgccaggcctccggaagggggaacggggtctggggagtgggtctacgtaggttacttacgtgggtagtaggtaaactccgatattacgtacgctacgtacctccggtacggaccggggtccggttaccacccggttctaccgaaggaccgaaccgttaacttacccgaaaaggtaaacttacccggggttaactaacgttaccgttaagggtaaaactcggtaaaacctcggtacccgtaggaacggtacggaccgggaacggacccgaaccgggtaccccttaacgttaacgtaccgttaggtcggaaccgtaggtagacttacccggaaagggtacggtaaccgttaagtaaccggacgtacggaaccgttaccggttaccgtaccgttacggaaccggtttaaccccgggg

SEQ ID NO: 60547 - DNA, 681 bp, Homo sapiens
  misc_feature: GYAE6OF02GU78Q.37.8.A08.1.454.CMB.1.raw
  modified_base (315)..(315): a, c, t, g, unknown or other
  misc_feature (315)..(315): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtcgttcctacggttgctacttttaaggaggtgtccagtgtcaggtgcacctggtggagtcgtgggggagcgtggtccagcctgggagtccctgacgctctccgtgtatagcctcgtggacttccaccttcagaccaactagtggacagtcgactacgtggggtacccnccgaggtcctaccgagggaccgaagggggtcctaggggacgttgggggtacggcgtaaggtttatacgtacgaggtataggagttagggaagttggttaggaacggtagttagtggacgacgtaccgttaccgggtagggaacgggtccgtaacttccgaaccgtactccgtaccgtagaacgtaacctaacgttacccgaaacgtaacctaactaaccttactacgttaccgtacgtaacctaaagtaaccgaaaccgtaacgacccttaaggaacgtaagacgaacggtaccgacgtcgtagttagtacgtacgtacgttacggacgtaaccggaacgggttaacggggttaggagtagtacgg

SEQ ID NO: 60548 - DNA, 616 bp, Homo sapiens
  misc_feature: GYAE6OF02GYZ5O.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctgggaggtccctgagactctcctgtatagcctctggattcaccttcagcaactatggcatgcactgggtcccgccaggcctccgaggcaaggggctgggagtgggtggcagttatatcagtatgatgggaagttggttaggaggtagtatggacaggactccggtggaacgggccgtattcgacctatcctaccgagacgaactaattaccaaagaaccacactactactactagactaaagtcgaaacgtacgaccgtagacggtacgaccggacgggaccgacccgggtaccccttaagtttaacgtttacgttacggttaggtaaccggtaaacggttcggggttaggggggggtacgggtacggggggttccgttaaccggttcccggg

SEQ ID NO: 60549 - DNA, 618 bp, Homo sapiens
  misc_feature: GYAE6OF02GTYG6.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctgggacggtccctgagactctcctgtatagcctctggattcaccttcagcaactatggcatgcacgtgggtcccgccgaggcctccgagggcgaaggggctgggaggtggggtggctaggttatatcaaggtatggattgggaaagttggttaggagggtagttaagtgacaagggaccttccggtaggaacgggccgtattacgacctatcctaccgaagaacgaactaacttaccgaaacgaaccaacaacctactaactctagaactaaagtacgaaacacgaccgtagaaacgtaacgtacggaaggacgacgggtacgttacggtagtaacgtactacgtggtacgtaccggtaaaccgggttaagggggtttacggacggtagtacgg

SEQ ID NO: 60550 - DNA, 777 bp, Homo sapiens
  misc_feature: GYAE6OF02HUEE3.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcaccgtggtggagtcgtgggggagcggtggtccagccgtgggacggtccctggagacctctccgtgtatacgcctcgtggattccaccttcagccaactatggcatgctacgtgggtcccgcgaggcctccgaggccgaaggggctgggaggtggggtggctaggttatatcgaagagttgaacgttgggtaaagttggttaggaacgggtagtttaacgtggaccgtaaggtaccggtcccgggtaagggaacgggggtacccggtaacgtttacccgaacccgtacgttacctacccggaaggaaaccgtaaccgtaaactttaacccgaaaacggtaaaccctaacctaaacctacctttaacgttaccgtaccgtaaaccgtaaacgttaacgaaaccgtaaccgtaacccgttaacggtaaaccggtaaacgtacggggaacgggtacccggtaaccggggtaccgttacgggtttaacgttaacggttacccgtaaccggtttacggtaccggggttaacccggggtaaaacccggggttaacggggggggttttaacgggaacgggttacggtaaccgggg

SEQ ID NO: 60551 - DNA, 751 bp, Homo sapiens
  misc_feature: GYAE6OF02HBNQT.37.8.A08.1.454.CMB.1.raw
  modified_base (327)..(327): a, c, t, g, unknown or other
  misc_feature (327)..(327): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagttgggctgagctgggtcttctcgttgcttcttttaagaggtgtccagtgtcgaggtgcaccgtggtggagtcgtgggggaggcgtggccagccgtggggacgtccctgacgacctctccgtgtatacgccttcgtggatttccgacccttcagtctaaccgtagtcggacctagtcgccgtacgtccgggtacccncccgaacggccttacccggacggaccggtaaggggtcccgtaggggtacgggttcggggtcgaccgttaagttaactacgttaccgaagtacgtaggtagtagggtaagttggtagggtaaggtaacgttagtggaccgtaggtacccgtacgggtaggaccggggtacctaacgtccgaccgtaccgtacgtacccgaaagaaccgtactaaaccgttaccgaaacggtaaacctaccgacttaccgtacgttaccgtaacaaccgtaaagttacccggaaacgtacccgtaaccgtaaacggaaacgtaaccggtaagtaaccggtccgtaacggtccgttagggttaccttaaccggtactacggttacgaccgggtaaccgggtaaccggggttaacggggttcggtaagcggtaacggg

SEQ ID NO: 60552 - DNA, 567 bp, Homo sapiens
  misc_feature: GYAE6OF02H0E3W.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggaggcgtggtccagcctggggaggtcctgagactctcctgtgcagcctctggattaatgttagcaactgtggcatgaaacgtgggtcccgccgaggctccgaggtcagtggggctgcgagtgggtctacgaagtactagtcgctccgtggtaatagagcagactacgcagactcgtgacgggccgtcacatcacagagacatacaagaacacgctacgtatctacgactaaacgtagaacacgccgtagaacgacgacgaaagaccgaccggaccgtaattacgtacgtaggtagtaggaaacggtcgtagggggacggtacgggggaacggtacggtaccggggaccgtaaaccgggg

SEQ ID NO: 60553 - DNA, 625 bp, Homo sapiens
  misc_feature: GYAE6OF02GEICO.37.8.A08.1.454.CMB.1.raw
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
tcagtagtgtagatcacgaccggtgctcgatttagcatactctacaggggcgtgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggagcgtggtccagcctgggacgtccctgacgactctcctgtatagcctntggattcaccttcagccaaactntggacagtcgcacgtgggtcccgcaggcctccgaggcaaggggctgggaggtgggtggctagttatagtcagatgagtgggaagttggtaggaggtagtagtcgcgaacgtaccgtccggtaggaacgggtccgtaagttccgaacctacgtaccgtaccgaaggaacgtaacgtaaacgttaccgaaacgtaaccactactactagtctagactaaagtacgaactacgaccgtagaacgtaacgtacggaacggacgacggtcgttaggtacgtaacgtccgtacgttacggtacggtaccggtaaaccggttaacggggggtttacgacggtacgtacggg

SEQ ID NO: 60554 - DNA, 577 bp, Homo sapiens
  misc_feature: GYAE6OF02JUZJL.37.8.A08.1.454.CMB.1.raw
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (491)..(491): a, c, t, g, unknown or other
  misc_feature (491)..(491): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttggctgagctgggtcttcctcgttgctcttttaagaggttgtccagtgtcaggtgcacctggtggagtcgtgggggaggcgtggttcaggccgtggggagtccctgagacctcgtcctgtatacgcctcgtggattccaccttcagccaactatggccatgcacgtgggaccccgagcctccgaggcgagggctggagtgggtncgtagttantcagaagtgagtcggtaagtggtagaggagtncggacagtacgtacggtaggaacgggcgtagttaccgactaactcgtaacgagaacgtaactaaacgtaccgaaagaaaccataccctagtactactagacctaatacgaacncgtacacgaagaactagtacgacgacgtcgtcgttacgataccgagtcgtacggaccgtaacggtacggggttagacggtagtcgg

SEQ ID NO: 60555 - DNA, 696 bp, Homo sapiens
  misc_feature: GYAE6OF02J241Z.37.8.A08.1.454.CMB.1.raw
  modified_base (187)..(187): a, c, t, g, unknown or other
  misc_feature (187)..(187): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctctttaagaggtgtccagtgtcaggtncacctggtggagtcgtgggggagcgtggtccagccgtgggaggtcccctggacgactctcctgtatacggcctcgtggacttccaccgttcagcaacttagtggcagtcgcacggtgggtccgcacggctccgaggcgaaggggctgggaggtcgggtgcgtaagttatagcgagtataggagtagggtaagttggtaggaaggtagttacgtcggacgtaacggtccgttaccgggtaagggtaacgggtaccggttactttaaccccgaaccgttaacgtaccgttaacccggtaaaggaaccggtaactaaacgttaacccgaaaagtaaaccgtaccgtaacttaccggacttacctagaacgtaaacgtacgaactacgttaaccgagtaaacggtaccgcggtaacggaccgtaacggtccgtcggtttacacgttccggaacgtttcggaacggtaacccggtaaacggggtttacgggtttaaggaccggttcgtaacggg

SEQ ID NO: 60556 - DNA, 698 bp, Homo sapiens
  misc_feature: GYAE6OF02HUK09.37.8.A08.1.454.CMB.1.raw
  modified_base (550)..(550): a, c, t, g, unknown or other
  misc_feature (550)..(550): n is a, c, g, or t
  modified_base (574)..(574): a, c, t, g, unknown or other
  misc_feature (574)..(574): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtggtcttcctagtgctctttaagaggtgtccagtgtcaggtgcaccgtggtgagtcgtgggggagcggtggtccagcctggggacggtccctgagtactctacctgtatacgcctctggatttccaccttcagaccaaacgttatggacagttgacctaaccgttcggggtaccccgccaagggtccctacccggagggaccgtaacgggggccttagggaacgggttgggtcgggacctaaggtttaagacgtacaaggtagttagaggttagggtaagttcggttaggagtacggttagtcgacctaagcccggttccgtaagggaccgggtacttaacgtccgaacctacgttctaccgagacgaaacgttacgttaaccgaaactaacgacctaactactanacgtgaactaaagtacaacgtacnccgttaaggaacaacggttaccgaagggaccgtaggttccgaaggtttactaaccgtaccgtacgttggtacccgggaaccggttaaaccggggttaacgggggtttagtacggaaggttccgg

SEQ ID NO: 60557 - DNA, 690 bp, Homo sapiens
  misc_feature: GYAE6OF02IDYK8.37.8.A08.1.454.CMB.1.raw
  modified_base (170)..(170): a, c, t, g, unknown or other
  misc_feature (170)..(170): n is a, c, g, or t
  modified_base (210)..(210): a, c, t, g, unknown or other
  misc_feature (210)..(210): n is a, c, g, or t
  modified_base (273)..(273): a, c, t, g, unknown or other
  misc_feature (273)..(273): n is a, c, g, or t
  modified_base (368)..(368): a, c, t, g, unknown or other
  misc_feature (368)..(368): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagnggttgtccagtgtcaggtgcacctggtgagtcgtgggggnggcgtggtccagccgtgggacggtcctgagacctctcctgtatagcctctggacttcaccttnagcaactagtggacattcgctacgtcgggtcccgccgtaacggcctaccgaggtcgaaagggggtccctgggacggtggggtacgctaggtttanaagttcagtatggaagttggaaacgttggtttaaggacgggtaattagtcgacgtacggtaccgttcccgggttaggaaccggggtccgtaacttcccgaaccctattacccgtacgaaggtaacgaaccttaaacgttacccaaaacggacctaaaccctaacgtacctacgttcttaacggaaccttaaagtcgaaaccttcggacccgttgtaaacgacgttaggggaacgaccgtaacggtcgttaggtacttacgaccttacggtacggtaccggtacgggaaacccggttagggggtttacggaggtccgtaacgg

SEQ ID NO: 60558 - DNA, 720 bp, Homo sapiens
  misc_feature: GYAE6OF02IWJA4.37.8.A08.1.454.CMB.1.raw
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
tcagtagtgtagatcacgaccggtgctcgatttagcatactctacaggggctgggagaggagccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtggggggagcgtggtccagccgtggggacgttccctgacgactctcctgtatcgcctctggattccaccttnacgcaactatggctacgtgactaccgttgggtccnctacggcctccggaaggtccgaagggggtctacgggagggtcggggtggacgttaaggttatacgacgtaggactagggaacgttaggggtaaagtggtttacggaaggttagtagtaccggtacgtacggtaccgttacgggtacgggtacgggtacccgtagttaccaacccgtactacgtaccaggaactacgtaaacttacgaaacgtaaccaactacctacttacgtactacgtaaccgtaaacgtaactaaacggtaacccgtaacggtaacgaacggtaccggaaaccggtaccggaaccggttacccgttaacgttaaacgtttaacggtaacgttaaaccggtaaagttccggtaaccgtaacggtaacgttaaccgtaacgtaaccgttaacgttaacggg

SEQ ID NO: 60559 - DNA, 764 bp, Homo sapiens
  misc_feature: GYAE6OF02GXT12.37.8.A08.1.454.CMB.1.raw
  modified_base (260)..(260): a, c, t, g, unknown or other
  misc_feature (260)..(260): n is a, c, g, or t
tcagtagtgtagatcacgaccggtgctcgatttagcatactctacaggggcgtgggagaggagcccagccactagaagtcggcggtgtttccattcggtgatcggcactgaacacagaggactcaccatggagtttgggctgagcgtgggtcttcctcgttgctcttttaagagtgtccagtgtcaggtgcaccgtggtggagtcgtgggggagcgtgtccagcctgggacggtcctgagactctcctgtactacgcctntggtacttccaccttcagacaacgttagtcggcatggacctacggttcggggtccccaccgtacgggccctccggaacgggaccggtaaaggggggtctaggggtagggttcgggggtaggtaccgttaaggttttaacgtagttaccaagggtaacgttggtaaggttaggggttaaggttgggtttacggaaggggtaagttaagtcggacggtaacggtaccgttaccggtacgggtaacgggtacccgtaaacgttcccgaacctacgttaccaccgaaggtaacgaaaccgttaacttaacccgaaaacgtaacctaaaccgaaccttaccttaataccgtaggaaactaaacgtaacgaaaccgtacgtaccttaaggaaacgttaaaccgtacgggaacggtaccgacgggtacgttggtaaccgttacgtacgtaacgtcggttaccggtaacggtaaaccggggttaaggggggtttacggacggtacgtacggg

SEQ ID NO: 60560 - DNA, 643 bp, Homo sapiens
  misc_feature: GYAE6OF02H0ZXQ.37.8.A08.1.454.CMB.1.raw
  modified_base (262)..(262): a, c, t, g, unknown or other
  misc_feature (262)..(262): n is a, c, g, or t
tcagtagtgtagatcacgaccggtgctcgatttagcatactctacaggggcgtgggagaggagcccagcactagaagtcggcggtgtttccattcggtgatcggcactgaacacagaggactcaccatggagtttgggctgagctgggtcttcctgttgctcttttaagaggtgtccagtgtcaggtgcaccgtggtggagtctgggaggaggcgtggtccagccgtgggacggtccctgacgactctcctgtatacgcctntggtattcctaccttcgagcaacttgtggcagtgccacgtggggtcccgcgtagggcctccgaaggcctaaaggtcgggacgttgggaggttggggtcggtacgtaaggtttaactacgtcgaaggtagttggaagtagggtaaggttgtaggaaggtagtagtcggactagtacgtcggtaggaacgggtccgtattcacctactcgtaccgagaacgaactaacttaccaaagaacactacgttactactacgtacgtaacaaagtacgaacgtacgtaccgtaagaagtaacgtaggaacggaccggaaccggtcgttaggtgttaacgtgtacgtacggtaccggtaacggtaaccgggttaggggttacgtaacgg

SEQ ID NO: 60561 - DNA, 670 bp, Homo sapiens
  misc_feature: GYAE6OF02JZ2MI.37.8.A08.1.454.CMB.1.raw
  modified_base (299)..(299): a, c, t, g, unknown or other
  misc_feature (299)..(299): n is a, c, g, or t
tcagtagtgtagatcacgaccggtgctcgatttagcatactctacaggggctgggagaggagcccagcactagaagtcggcggtgtttccgattcggtgatcggcactgaacacagaggactcaccagtggagtttgggctgagctgggtcttcctcgttgctcttttaagaggtgtccagtgtcaggtgcactggtgagtcgtgggggagcgtggtccagcctgggagtcctgacgacgtctcctgtatagcctgtggattcaccgttcagcaactatggcatgctacgtggggtccnccaggcctaccgaggtacgaagggggtctgggagtggggtcgactagttactacgtcgaaggtactgggattcgggaaaggtttcggttaggaaggtagttacgtaggacgacgtaccgttaccgggtaggaaacgggtcccgtaagttaccgaacctagtaccgtaccgtaagggacgtaacctaacgttacccgaaacgaaccctaccgtaaccttacgtaacctacgtacggtaccaaagtaccggaactaccggtaccttaggaaacgtaaccgacgggtacggacgaccgggtatacgggttaacttacgtactacggttaggtaccggaacggttaaccggtaggggtttacgaggtactacggg

SEQ ID NO: 60562 - DNA, 643 bp, Homo sapiens
  misc_feature: GYAE6OF02JVEY8.37.8.A08.1.454.CMB.1.raw
  modified_base (168)..(168): a, c, t, g, unknown or other
  misc_feature (168)..(168): n is a, c, g, or t
  modified_base (287)..(287): a, c, t, g, unknown or other
  misc_feature (287)..(287): n is a, c, g, or t
  modified_base (420)..(420): a, c, t, g, unknown or other
  misc_feature (420)..(420): n is a, c, g, or t
  modified_base (448)..(448): a, c, t, g, unknown or other
  misc_feature (448)..(448): n is a, c, g, or t
  modified_base (494)..(494): a, c, t, g, unknown or other
  misc_feature (494)..(494): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctggtcttcctcgttgctctttaagnggtgtccagtgtcaggtgcacctggtggagtcgtgggggaggcgtggtccagccgtggggacggttccctggacgtactctccgtgtatcgcctctggattccaccttcacgcaaactntggcatcgcacgtgggtccgcgagggcctccgaggcggtaacggggcttagggacgtcgggggcgtaggtacgtacggacgcgtaagtcgagtatggaagtcggttagaggtatgtacggcgtagcgttcggngaacggtcgagttcgacacttcgaccgngaacggtactaacgtcgtaacaactcctaactcttaactcgttaanaccgaaacgttggaaacttacggaccttcgggaaagtaccttacggggacgtaaccgggttaccgcggttaccggttagtacccggtaattacccgggagttaccggaacgggtaacccgggttaggggttaccggaggtacgtccggg

SEQ ID NO: 60563 - DNA, 727 bp, Homo sapiens
  misc_feature: GYAE6OF02JHNNA.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcaccgtggtggacgtcgtgggggagcgtggtccagccgtggggacggtccctggacgaccgtctcctgttatacgccttctaggtacttcctaccttcgacgacctaacttacgtggctagtcgcctacgtcggggtcccgcctacgggcctaccggaggacgaacgggggtctggggaggttggggtcggtactaaggtttatagttcggaagtacgtgggtaacgttagggtaaaggttggttagggaacggtagtaagtcgacggtaacggaccgttccgggtagggaacggtaccggtaagttacccgtaacgtacgtaccgtacgaacggaacgtaaccgtaacgttaaccgaaacgaaacctaactaaccttacttctaccgtagtaacctaaacgtacgtaacgaccgtactaacgaaacggtaacgtacgaacggtaccgaacgggtactcggttaactacgtaccgtacggtaccggtaacggtaaccgggtaaaccgggttaaggggttacggtacggtacgtaacgg

SEQ ID NO: 60564 - DNA, 545 bp, Homo sapiens
  misc_feature: GYAE6OF02FSB5L.37.8.A08.1.454.CMB.1.raw
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagcctgggagtccctgagactctcctgtatagcctctggattcaccttcagcaactatggcatgcactgggtccgccaggctccaggcaaggggctgggagtgggtggcagttatatcagatgatgggaagtgttgaggagtatgacagactccggtagaagggccgattcaccatctcagagacaattccaagaaccacactctactctagacaaatagaaacacgtacctagaacgtaactaggaacggacaacgggctggtacgtacgtactacgtggtacgaccggtaaaccggtaaggggggtttacggaggtagtacgg

SEQ ID NO: 60565 - DNA, 610 bp, Homo sapiens
  misc_feature: GYAE6OF02GVDRX.37.8.A08.1.454.CMB.1.raw
  modified_base (257)..(257): a, c, t, g, unknown or other
  misc_feature (257)..(257): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggagcgtggtccagccgtgggaggtccctgagactctcctgtatagcctntggtattcaccttcagcaactatggcatcgcacgtcgggtccgccgaggcctccgaggacgaaggggctgggaggtggggtcggactagttatatcagtatgaagtaggtaagtggttaggagggtagtagtgactagacgtccggtaggaacgggccgatccacacttctaccgagacgaacctaacttaccgaaagaaacctactaacttactacttctacgaacaaagtacgaaacgacgtacctaggaacgtaaacgagaacggacgacggtacgtcgttagttaacgtacgtaacgttcggtacggaccggtaaaccggggttaagggggtttaggaacggtgtacgg

SEQ ID NO: 60566 - DNA, 773 bp, Homo sapiens
  misc_feature: GYAE6OF02FTFYH.37.8.A08.1.454.CMB.1.raw
  modified_base (169)..(169): a, c, t, g, unknown or other
  misc_feature (169)..(169): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagttgggctgagctgggtcttcctcgttgctcttttaagnggtgtccagtgtcaggtgcacctggtggagtctgggggaggcgtggtccagcctgggaggtccctggagactctcctgtatagcctctggattccaccttcagcaactagtggcatgcacgtcggggtcccgccaggcctcccgagggaccgaagggggtctaggggacggttgggggtacggcgtaaggtttataacgttcgaaggtacgttgggaagttacggggaaagtttgggtttaggaaagggggtagttatcgggacctaagggtacccttaccgggtaggaaacggggtcccggtaacgtttccgaaaccctacgttaccgtacccgtaaggtaacggaaccttaaagttaccccgaaaaggtaacccaacccgtaacccttacgtaacttaccgtaggaacctaaaggtacgtaaaaccgacggtaacccgtaaggaaagttaaacccgtagggaaaccggggtaacccgtaccggggtaccgtcggtttaaccggttacgttacccggttaaccgttacgggtaaccgggttaacccgggtaaacccggggttaaaaggggggggttttacggtaaccgggaaggtttaccggg

SEQ ID NO: 60567 - DNA, 675 bp, Homo sapiens
  misc_feature: GYAE6OF02IHQ2R.37.8.A08.1.454.CMB.1.raw
tcagtagtgtagatcacgaccggtgctcgatttagcatactctacagggggctgggagaggagcccagcactagaagtcggcggtgtttccattcggtgatcggcactgaacacagaggactcaccatgggagtttgggctgagcgtggtctctacgtgctactttaagagtgtctagtgtcaggtgcacgtggtgagtcgtgggggagcgtggtccagccgtgggacggtccctggagacctctccgtagtactagcccttgtggactttccaacccctttcaggtaccctaaatagtcgggacctatcgtcctaacggtcgggtaccccgcgacggtacctcccgagggcgacggggctgggacgggttggggtcgcgttaaggtttacatcggtagattaggagttgggtaagttggttagggaaggtagtagacggcgtaacggccgttacggtagggtacgggtacgtactactaaccgtcttaccacgacgacgaaccttaaccgttaaacaaacgacccgtacctacgtacctaactctaaccgtaataacgtaacgtaacgaccggtaacgtacggaaacgtaccgtacggaaggtaccgagggttacctgtacggtcacgttacgtaggtaccgtagggtaaccggtaggggtagaccgtgtacgg

SEQ ID NO: 60568 - DNA, 613 bp, Homo sapiens
  misc_feature: GYAE6OF02G3Q2Z.37.8.A08.1.454.CMB.1.raw
  modified_base (159)..(159): a, c, t, g, unknown or other
  misc_feature (159)..(159): n is a, c, g, or t
  modified_base (166)..(166): a, c, t, g, unknown or other
  misc_feature (166)..(166): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (181)..(182): a, c, t, g, unknown or other
  misc_feature (181)..(182): n is a, c, g, or t
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
tcagtagtgtagatcacgaccggtgctcgatttagcatactctacagggctgggagaggagcccagcactagaagtcggcggtgtttccattcggtgatcggcactgaacacagaggactcaccatgggagtttgggctgagcgtggtctccagtgctntttaagngtntcngtntcagtnnactggtgagtcgtggggagcgtggtccagccgtgggcgtcctgagtctctccgtgtactgcctagtgtcttccaccttcgcgactaactgtggctagcgngacgttcgggccacgnggtccaccgaggccgtaaggggcctaggcgttggggcacgtagtatatangatggtagtacggaagttgttaggaggaattagcggactacggtactcggacgggaacgtaccggtacttacacccagttcccggacacggttaacgaaacaactttaaccggaaaactaaccgaccttaaactaccgtcttacgtaccataacgtataacgacttacgacgtaacgaacgacgacggacgacgtacgttacgtcgtacgtacgtaacgtgtacggtaccggtaacgggtaaccgggttacggtagtaggtacgg

SEQ ID NO: 60569 - DNA, 592 bp, Homo sapiens
  misc_feature: GYAE6OF02F5GZB.37.8.A08.1.454.CMB.1.raw
  modified_base (408)..(408): a, c, t, g, unknown or other
  misc_feature (408)..(408): n is a, c, g, or t
  modified_base (491)..(491): a, c, t, g, unknown or other
  misc_feature (491)..(491): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtggggggaggcgtggtccaggcctggggacggtccctggagactctcctgtatagcctcgtggacttccgaccttcagcaactatggcatgactacgtggggtcccgccgagggcctaccgagggcgaagggggctgggaggttgggggtggtccgtagtttatatcgaagtatgagtgggtaagtggttagagggtagtagtgngaacgtccgtcggtaggaacgggcgtacttccacctacttccaccagacgaactaacgtaccaagaaccactactctatacgnactaatacgacacgcctagacgtaagcgaggaccacggtacgtcgtagtactactagttggacggtaccggtaaccgggttagggggtacggtagagtcgg

SEQ ID NO: 60570 - DNA, 666 bp, Homo sapiens
  misc_feature: GYAE6OF02I9GZX.37.8.A08.1.454.CMB.1.raw
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
  modified_base (394)..(394): a, c, t, g, unknown or other
  misc_feature (394)..(394): n is a, c, g, or t
  modified_base (445)..(445): a, c, t, g, unknown or other
  misc_feature (445)..(445): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtacttcctcgttgctcgtttttaagaggtgtccagtgtcaggtgcaccgtggtggagtcgtgggggaggcgtggtccaggccgtgggagtccctgagtactctcctgtatagcctctggattcgaccttnagcaacctatggccatgcacgtcggtaccgccgtaggcctccgaggtccgaaggggcctgggagtcgggngactaggttatagcagagtgagtaggaagtcgttaggacgggtagtntagggacacgtaccgtccggacggacgggtaccacgtttacgaacccgttntaccgtaccgaagggaacgtaacctaaacgtttaacccaacgtaaacctaccaaccgttacctaacgtcgttacgaacgtaaacgttacgaaaccgttacgacccgtagaaacggtaaccgttaaggacggacgtaacggtacgtaacgttacgtaagtaccgtacgtggttaaccggtaaccgggtaaaccggtagggggtttagacggtagttacccgg

SEQ ID NO: 60571 - DNA, 801 bp, Homo sapiens
  misc_feature: GYAE6OF02GK0CM.37.8.A08.1.454.CMB.1.raw
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (306)..(306): a, c, t, g, unknown or other
  misc_feature (306)..(306): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagnggtntccagtgtcaggtgcaccgtggtggagtcgtgggggagcgtggtccagcctggggacgtccctgacgctctcctgtatcgcctgtggattccaccttcagactaactagtggacagtcgctacgtcgggccncgacggcctccgaggacgaaggggtctaggggagtggggtcgacgtagttacgtatacgaaggtactaggtaacgttagggtaaggtttacggtttaggaaggggttaacgttacggttacggaacccggtaaccgggttaacccggttaccggggtaacggggtaaacccgggggtcccgtttaaaccgttaccccggtaaccttaacccgttacccggttaaccggtaaacggtaaaacccggttaaaccgttaaacccgttaaacccgaaaaaccggtaaacctaaccgttaacccgttaaccgtttaccgtacgttaaaccgaaaccttaaacggttaaccgtaaaccgaccggttacccgtaaagtaaaccggtaacgtacgggaaccgtaccggaccggtttcggtaagttacgtacgttaccgacggttagtacccgggttaaccgggtaaaccggggtttaggggttacggaacggtaggtaaccgg

SEQ ID NO: 60572 - DNA, 587 bp, Homo sapiens
  misc_feature: GYAE6OF02HU4QP.37.8.A08.1.454.CMB.1.raw
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
tcagtagtgtagatcacgaccggtgctcgatttagcatactctacaacgacacaaaggggctgagagaggagccttagccctggattccaaggcctatccacttggtgatcagcactgagcaccgaggattcaccatggaactggggctccgctgggttttccttgttgctatttttagaaggtgtccagtgtgaggtgcagctggtggagtcgtgggggagcctggtcaagccgtggggagtccctgagactctcctgtgcaggcctctggattcaccttcagtagctaatagcatagaactgggtccgaccaggcgtccgaaggggaaggggctgggacgttgggtctcgatccatttagtagtagtggtacttacattaactactacgcaacgtactcgaggtacggaggggcctagttccaccgataccgtcagtacgaacaaacgtacaagtaacctnactgtattacganacaaatcgaacgagaccgtagaacggacgccgggtaagaccgtaacgggcttaggttacgtaacgtttacgtggtacgcggaacgtaccgaccccgttacccaccctaccg

SEQ ID NO: 60573 - DNA, 666 bp, Homo sapiens
  misc_feature: GYAE6OF02JI00T.37.8.A08.1.454.CMB.1.raw
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (396)..(396): a, c, t, g, unknown or other
  misc_feature (396)..(396): n is a, c, g, or t
  modified_base (558)..(558): a, c, t, g, unknown or other
  misc_feature (558)..(558): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagnggtntccagtgtcgaggtgcaccgtggtggtagtcggtgggggaggcgtggtccaggccgtggggacggtccctggacgacctcctcctggtactacgtccttcgtaggtaacttccaccttgacgtacaaactgtggactatcgcgtacgtcgggtccgaccgaggtcctaccggacggaccggaggggtcctaggggtacggtggggtcggtacgtagtttacngtacgagtagtaggagttacgggtaagtcgggttaggaggtaacgttagtagacgtacggtacccgtagggtacggacgggtaccggtactaccgtactacgtccgtacgaagtaacgtaactaacgttaacgaaacgtaaccacctactactactaccgtnaaaccgtaagtacgaactaccgtacgtacggaactacgtaacgacgacgtagtacgtagtagtactacgacgtgacggtaacggtacggttagggtgaggtagtacgg

SEQ ID NO: 60574 - DNA, 913 bp, Homo sapiens
  misc_feature: GYAE6OF02HLLIC.37.8.A08.1.454.CMB.1.raw
  modified_base (121)..(121): a, c, t, g, unknown or other
  misc_feature (121)..(121): n is a, c, g, or t
  modified_base (381)..(381): a, c, t, g, unknown or other
  misc_feature (381)..(381): n is a, c, g, or t
tcagtagtgtagatcacgaccggtgctcgatttagcatactctacaacgacacaaaggggctgagagaggagcctttagcccccgtaggtactaccgaacggtctactcctacgttgggtnactcgacgacctacgtaggacgaccgaaccgggtaaggtacttaccgaacctaggtaaccggtaacgggtcggggtccctccggttcgggtttttccgggttttttacccgtttggttacgtacctttttaaggttttaaagggaggttccgtaccgtaggttggtacgggagggtcgacgacggtcggttgggtacggtacgttcgggggtgggggtacgtccgtacggtaacgaccgtccgggtagggtaccttccgnggaacgtctctcgtgcgcacgtcctggtgtactcctacctgagtctctagtacgactgtaacgtacggtcgggcccacggtaccgtcctaacgggggaagggagggtcgtaggtcggggtacggttcccacgacttaaccgttagtttaacggtaggtttacgtttaccgttaacaacgttataacgtttaaccgacgaacgtaacgggttcctaacgtagggtacggggaaccggtccttaacgtttacaaccgtaccgtttacgacccggtaaaggtacccgaaaaccggtaccgtaaccggaaaaccttaccgtaccgttaacgttacggttaacctttaccggaaacgtaaaccgttaaggtaaccgaaccggttccgaccgggttaacgaaacgggtacccgggaccgggggtaaccgaacgggttaccccgggttggttaccggttaattttaacccggttcggaaccgttcgggaacccggttaccgaacccccggtttaccccttaccccgtaaccgttaccgg

SEQ ID NO: 60575 - DNA, 827 bp, Homo sapiens
  misc_feature: GYAE6OF02JWQ0B.37.8.A08.1.454.CMB.1.raw
tcagtagtgtagatcacgaccggtgctcgatttagcatactctacagggctgggagaggagcccagcactagaagtcggcggtgtttccattcggtgatcggcactgaacacagaggactcaccatggagtttggctgagctgggtcttcctcgttgctcttttaagaggtgtccagtgtcgaggtgacaccgttggtggacgtcgtggggggaggcgttggcccaggccgtggggacggtccctaggacgacgtcctcgttgtactacgtcctcgtaggtacttccacctttcgacgtctaacctagtaggtcctaagtcggaccgtaaccggttggggtaccccgaccggtacggtacccgtaccggagggtacccggaaagggggtccgttaggggtaacgggttgggggtacggtaccggttaaagttaacgggtttaccaacggtaacggtaagtttcgggaaaccggttaggggtaaagtttcggggttaagggaagggtaagttaaaggtccggtaacccggtaacgggtaccgttccggtaacgggtaaccggggtaccggttaagttaacccggtaccgtaacgttaccgtaaccgaacggtaaccgaaacgttaaccttaacccgaaacgtaaccgtactaaccgtactacgttaccgagtaaccgaaagtaccgtaaacgcgtaacccgtaagtaaccgtaaacgtacggaagttacgaccggtacgttacggttaccgtacgttaccaacggttaccgtaaccggttaaccgggtaacgggtttacggggttaaccggttagttaaccggtacgg

SEQ ID NO: 60576 - DNA, 686 bp, Homo sapiens
  misc_feature: GYAE6OF02FO4V7.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcaccgtggtggagtcgtgggggagcgtggtccagccgtgggacggtccctgacgactctcctgtatacgcctcgtggtattccgacctttcgagtacctaaactagtcggacctagtcgaccacggttcggggtaccccgccgacgggtccctaccgaagggtcgaaacgggggctaggggacggtggggtcgacgtagttatatcgaagtcgtaggagtacgggaagttggttaggaaggtagtatgacgtaagtccgtaccggtaggaacggtccgtagttaccgaacctctacctaccgagtaacgaactaaaccccgttacaaacgtaacctaccgtacttaccttataccgttacgaacttaaacgacgtaaaccgacgtccgtaaggaaccgtaacgtacggtaacgaccgtacggtacgttacgtaacgttacctacggtacgttggaacgtaccgggtaaacgggttaacggggttagaggtcgtaacgg

SEQ ID NO: 60577 - DNA, 753 bp, Homo sapiens
  misc_feature: GYAE6OF02H8K7J.37.8.A08.1.454.CMB.1.raw
  modified_base (705)..(705): a, c, t, g, unknown or other
  misc_feature (705)..(705): n is a, c, g, or t
tcagtagtgtagatcacgaccggtgctcgatttagcatactctacaggggctgggagaggagcccagcactagaagtcggcggtgtttccattcggtgatcggcactgaacacagaggactcacatggagtttgggctgagcgtgggtcttcctcgttgcttctttaagaggtgtccagtgtcaggtgcacgtggtggagtcgtgggggagcgtgtccagccgtgggacggtcctggagactctctgtatacgcctgtggacttccaccttcagaccaacttagtcggcacgtgaccgaggttccgggtcccgccgacgggcctacgacgggacgaacgggggtcctaggggaggttcgggggtacgggtactaacgggtttaatacgtaccggtaagtagttaaggtaaggtacgggggtaaagtttggggtacggtaaggggtaaaacttgtacggaccgtaggtaaccccggttaccggggttaacggggaaaccggggttccccgtaaaggttttaccccaaaccggtaacgttacccggttacccgaaaggtaaccgtaaaaccgttaaaccgttaaccccggaaaagtaaaccaacccgttaacttaactacgttaccgtaacgaaacctaaaagacgtaaaccgaccgttaccgtaagaaacgtaaccgtaggacggaccgaggttcgtagtacgtanccgtagtcgtacggaacggtaaacgggttacggggtagacgtagtcgg

SEQ ID NO: 60578 - DNA, 759 bp, Homo sapiens
  misc_feature: GYAE6OF02IFXK6.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacgtggtggagtcgtgggggagcgtcggtccagccgtgggacggtcccctggacgtacctcgtcctgtactacgccttctggtactttccaccctttacgacgtaccgtaaactacgttggaccgtagttcgacccgtaaccggttccgggggtaccccgccccggacgggtcccttacccggagggtaccggaaacgggggtcttacggggtaagggttgggggttacggtacgtaggttttaacgtagttccgaagtacgtgtacggttagggtaaacgttggttagggaacgggtaagttacgtggaccgtaggtaccgttacccggtaggtaccgggtaccgtacgtacctactactcctaccgtacgacgtactaacttacccgaagaacctacctaccgttaccttacttaccgtacgtaacctaacgtaacgtaacctaacgtaccgtaagtaacgtaaccgtagaaccggacgtaaccgtcgttaagtacgttaacgtccgttacgtacggttaccggaaccggtaaccggttaacgggggttacggttacggtagtacggg

SEQ ID NO: 60579 - DNA, 629 bp, Homo sapiens
  misc_feature: GYAE6OF02FVKCX.37.8.A08.1.454.CMB.1.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtctgggggaggcgtggtccagccgtgggacgtccctgagactctcctgtatagcctntggattcaccttcagcaactatggcatgcacgtcgggtcccnccgaggcctccgagggccgaaagggggcctggggaggttggggtcggcgtaagttatacgtcgaagactggaagtgggtaagttgttaggagggtagtagtgacgagccgtcgtaggaacgggacctagttccacctatctaccgagaacgaactaacgttaccaaagaaccaacctacctacttactactagaacgaatacgaaacgacgtacctaacggaagtaaccgtaggaacgtaccggaacggtcgtacggttacgtacgttaccaccgttgtacggtacccgggttaaacccggttaagggggtttacggacggtaggtacgg

SEQ ID NO: 60580 - DNA, 781 bp, Homo sapiens
  misc_feature: GYAE6OF02IB8IA.37.8.A08.1.454.CMB.1.raw
  modified_base (332)..(332): a, c, t, g, unknown or other
  misc_feature (332)..(332): n is a, c, g, or t
  modified_base (661)..(661): a, c, t, g, unknown or other
  misc_feature (661)..(661): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctcgttgcttcttttaaggaggtgtccagtgtcaggtgcacctggtggagtcgtgggggagcgtggtccagccgtggggacggtccctggactacctctccgtagtatacgcctctggtacttccacctttcgagtcctaaactagtcggacagttcgcctaacggtcgggggtccccnccggtaacgggtcctccgaagggtccggaaacgggggtctaggggtaggtcgggggttcgacttaagggtttaacactacgaagtacgttaggaggtaggtagttggttaggaagggtagtacgtcggacgaacgttaccgtaccggtaagggtaacgggtaccgtaacttaccgtaccgtaactacccgtaccggtaaagaccggtaaacctaaaccggttaacccaaacgggtaaacccaaccttaaccggttacctttaacgtacgttaacgggtaaacctaacggtaaccgaaaccggtacgttaccgaacgtaagtaaaccggnggtaaccgggaaccgttcgggtaacgtcggttaacgtacgttaacccgttaacggtcggttaacggtaaacccggggttaacggggttaacggggggtttaccgaaacggtgtaaccggg

SEQ ID NO: 60581 - DNA, 729 bp, Homo sapiens
  misc_feature: GYAE6OF02GT02Q.37.8.A08.1.454.CMB.1.raw
  modified_base (169)..(169): a, c, t, g, unknown or other
  misc_feature (169)..(169): n is a, c, g, or t
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
tcagtagtgtagatcacgaccggtgctcgatttagcatactctacaggggctgggagaggagcccagcactagaagtcggcgggtgtttccattcggtgatcggcactgaacacagaggactcaccatggagttgggctgagctgggtcttcctcgttgctctttaagnggtgtccagtgtcaggtgcacgtggtggagtcggtgggggnggcgtggtccagccgtggggacggtccctgacgactccgtcctgtactacgccttcgtgggtacttccgtaccctttgacgacctaaactagtggacngttcgcgtacgtcggggtcccggccgaggccctaccgtacggggaccgggaacgggggtcgttacggggacgggttgggggtacggtacgtaaggttaatacgtagacgtagtaggtagtagggtagttggtacggaggtaacgtgtacggacgtacgtaccgtccggtacggaacgggtctacgttaccacctagtcccgtaacgaaggtacgaaccgttaacaaccgaacgtaacccaacctaccgttacttacgtacgtacgtaaactaacgtaacgtaacgaccgttaccgaaggtaacgtaacgtaccgggaacggacgtacgggtacgtcggttaagtccgtaacgtacgttcggggtaaccgtaaccggggttaaacggggttaacggggtttagggtaaccggtaggtacggg

SEQ ID NO: 60582 - DNA, 886 bp, Homo sapiens
  misc_feature: GYAE6OF02HICFL.37.8.A08.1.454.CMB.1.raw
  modified_base (161)..(161): a, c, t, g, unknown or other
  misc_feature (161)..(161): n is a, c, g, or t
  modified_base (168)..(168): a, c, t, g, unknown or other
  misc_feature (168)..(168): n is a, c, g, or t
  modified_base (185)..(185): a, c, t, g, unknown or other
  misc_feature (185)..(185): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctggtcttcctgttgcttntttaagnggtgtcagtgtcaggtncacgtggtggagtcgtgggggagcgtggtccagccgtgggacgtcctgacgctctcgtgtatcgcctgtggtactttccaccgttcaacgtactaacgtagtggactagtcggaccgtacggtccggggtcccgaccgtacgggtccctacccggaagggaccgggtaagggggtcgtacgggggtaagggttcggggtacggtaccgttaaaggtttaagtacgttacggaagttaggttacgggtaaggttaaggggtttaaaggttgggtttaaggggtaaggtaacggtttagtcgggtaaccgtaacgggttacccgggttacgggtaacggggtaaaccggggtacccgttaaccggttacccgaacccgttaaccgttacccgtaacggtaaacggtaacgtaaaccgttaaaccgttaaaccggaaaaccgtaaaccgtaacccttaaaccgtttacccgtaacgttaaccgttaaacgtaaaccgtaaaacgtaacccggtaaaccgtaaccggttaccgttaaaccggtaaaccggtaaacggtaacgggtaaaccgggtaacccgtacgggtaccggtttaacggttaacggtttaaccgtaaccgttaccgggttaacgggtaccgggttaaacccgggtaaaccgggggttttaaggggggttaacggtacgggttacggtaaccggg

SEQ ID NO: 60583 - DNA, 903 bp, Homo sapiens
  misc_feature: GYAE6OF02H6LSV.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcacctggtggagtcgtgggggagcgtggtccagccgtggggacgtccctggacgaccttcgtccttggtatacgtcccgttcgtggtactttacctaacccgtttcaacggtaccaaacgttaagtcgggacctagttcggacctaaccggttccgggggtcccccacccggtaacggggtccctacccggaacggggccggaaaacgggggggttcttacggggggtaaggtcggggggttagggacctaagggttttaaactacttccggaaagggtacgtttaggaaaggttaggggtaaagggtttaggtttagggaacggggttaagtttacgggttcggaacgttaacgggaaccccgttttccggggtaacggggtaaacgggggtaccccgtttaaacgtttaccccgaaacccgttaaccgttacccgtaacccgaaacgttaacgtaaacccgttaaaccgttaaacccgaaaaccgtaaaccctaaacccttaacccgtttaacctaaccgttaacgttacggaaaaccgttaaacgtacggtaaaccgtaaccgtaccgtaacggtaaacgtaacgacgggtaaacggaccggtaaccgggtcgttaaccggttacggttaactaccggtaccgttagggtaaccggtaacccgggggtaaaaccgggtttaacggggggttttaacggacgggtaagtcgg

SEQ ID NO: 60584 - DNA, 678 bp, Homo sapiens
  misc_feature: GYAE6OF02GFWP4.37.8.A08.1.454.CMB.1.raw
  modified_base (260)..(260): a, c, t, g, unknown or other
  misc_feature (260)..(260): n is a, c, g, or t
  modified_base (313)..(313): a, c, t, g, unknown or other
  misc_feature (313)..(313): n is a, c, g, or t
  modified_base (639)..(639): a, c, t, g, unknown or other
  misc_feature (639)..(639): n is a, c, g, or t
tcagtagtgtagatcacgaccggtgctcgatttagcatactctacgaggggctgggagaggagcccagcactagaagtcggcggtgtttccattcggtgatcggcactgaacacagaggactcaccatggagtttgggctgagctgggtcttcctcgttgctcttttaagaggtgtccagtgtcaggtgcacctggtggagtcgtgggggagcgtggtccagcctgagaggtccctgacgactcgtcctgtatacgcctntggattccaccttcgagaccaacttagcggacatcgactacgtggggtacccnccgagggtcctaccgagggtcgaaggggtccttgggacggttggggcggtacctaggtttaataacgttcgaacggtagttaggagttagggtaagttcggttaaggaacggtagtaacgtggacctaaggtaccgtccggtaacggacggggtacctacgttaccgaccgtacgtaccgtacccgaagtaccgtaaacgtaacttaacccgaaacgaaccaacgtaaccgttacgtacgttaccgagtaaccgtaaagtacgtaaaccgacgtaccgtagaacgtaacgcgacgggacctacgggtactagtacgtactcggtancggtacggtaccgtaacgggtacggggttacgagtacgg

SEQ ID NO: 60585 - DNA, 852 bp, Homo sapiens
  misc_feature: GYAE6OF02F14UT.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtgcaccgtgggtggagtcgtggggggaggcgtggtccagccgtggggacgtccctagacgacttctccgtgtatacgcctcgtggattaccaccttcagacctaaacttagtcggcagtcgcctacgtcggggtcccgccgaaggtccgtaccgaggggtacgaaacggggggtccttagggggacggttcggggggtacggtacgttaacggttttaacgtaacgttaccgtaaaggagtttagggtaaagtttacgggggtaaaaggttttcgggtttaaggggaaggggttaacggtttaacgtgggtacccgttaaagggtaacccgttaccggggtaaggggtaaaccggggtacccgtaaacgttacccgaaccgtaaccgtccgtaaccgaaggtaaccggtaacctaaacgttaacccaaaggtaaacccgtaacctaaaccttaccgttaacgttaccgtaacggtaaaccgtaaaacgttaacgaaaccgtaccggtaaccgttaacggaaacggttaaaccggtaggaaacggggtacccgtaacggggtacgttaacggttacggttaacgttaccggtaacggtttccgggacgtaacccggggttaaaacccggggtttagggggtttaacgggtacggtaggttaaccgg

SEQ ID NO: 60586 - DNA, 708 bp, Homo sapiens
  misc_feature: GYAE6OF02G373T.37.8.A08.1.454.CMB.1.raw
  modified_base (166)..(166): a, c, t, g, unknown or other
  misc_feature (166)..(166): n is a, c, g, or t
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtctctgttgctctttaagngtgtccagtgtcaggtgcacgtggtggagttcgtggggggagtcgtggtccaggccgtggggacgtccctgagtacctcgtcctgtatcgccctgtggacttccaccttnaagtcaaactgtcggcatgactcgtgggtcccacgnggtcctccgaggccgaaggggctacgggaggtggtaggactaggttaactgtcgaagtcgtggaacgttagggtaagttggtacggaggtacgttatgacgtacgtccgtcggaggaacggtaccgtaagtaccaccgtagtccgtacgaaggaacgtaacctaacgttaaccgaaacgtaaacccacgtaaccgttactacgttaccgtaacgtaaccgtaaagtaccgtaaccgaaccgttaccgtaaggtaaaccgttaaccggtacgggtaaaccggacggttaaccgggttacggttacggttacggttaaccgtccgttaaccgggtcggtaacggggttaaccggtaaaccggggtttaagggggttaccggacgttacgggtaccggg

SEQ ID NO: 60587 - DNA, 730 bp, Homo sapiens
  misc_feature: GYAE6OF02HEJGD.37.8.A08.1.454.CMB.1.raw
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgcttcttttaagaggtgtccagtgtcaggtcgcaccgtggcggtagtcgtggggggagcggtggtcagccgtggggacgtccctgacgcctctccngtactagcctntggattcaccttcagcaactagtcgtacacgttgcctacgtcgggtccccgccgagggaccctccggagggaccggaacgggggcttaggggacggtggggtacgggaccgttaaggttttaaacgtccgttagaaagggtacgttagggagtaagggtaaggttcggttagggaaggtaaggttagtacggaccgtaaggtacccgtaccggttaagggtaaccgggtaccgtaccgttaccgtaccctagttaccctacgagaaaccgtaacgtaacgttaacccaaagaaacccgtcctaaccttctaactccgttagaacttaaacgaacgtaaccgacgtaccgttaacggaacgtaacgtacggtaaggaccccgtacgggtcgttacggtacgttaactaccgtagttacgtaccggtaccggttaacgggttagggggttacgtaggtaaccgtcgg

SEQ ID NO: 60588 - DNA, 856 bp, Homo sapiens
  misc_feature: GYAE6OF02IACPV.37.8.A08.1.454.CMB.1.raw
  modified_base (236)..(236): a, c, t, g, unknown or other
  misc_feature (236)..(236): n is a, c, g, or t
  modified_base (271)..(271): a, c, t, g, unknown or other
  misc_feature (271)..(271): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagagtgtccagtgtcgaggtgcacctggtggagtcgtgggggagcgtggtccaggcctggggagtcccngagactctctgtatagctcgtggtacttcaccttnagacaacgtatggactagtgacctacggtcgggtcccgccgacgggcctaccgaagggccgaaagggggtctaggggtagggtcgggtagggtcctaaggttactataccggagtacgtggaagttagggtaaaggttggttaagggtagggtaaacgtttagcggtacgaaacgggttacccgttaccggggtaacgggtaacggggtaccccggttaacgtttaacccgtaacccgtaacggtttacccgtaacccgtaaacgggtaaccggtaaacctaaaacggttaacccgaaaacccgtaaaacccgtaaaccgttacccttaacgttaaccttaccgttaacggtaaaccaaaacgttaaccggtaaacctaaccggtacccggtaaacgaaacgggaaacccggttaaccggaaacggtaaccccggtaacccggggttaaccccggttaaacggtttaacgtttaaccggtacggtttaaacgggtaacgggtaaaccggggttacggggttaaccgggggggtaagggggttaaccgggggggtacccggtttaaccgggggtaacccggggggg

SEQ ID NO: 60589 - DNA, 939 bp, Homo sapiens
  misc_feature: GYAE6OF02F0Q2D.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttggctgagctgggtcttcctcgttgctcgtttaagaggtgtccagtgtcaggtgctaccgtggtgagtcgtgggggagcgtggtccaggtccgtggggacggttcccctaggacgtaccgttccttccgttagttaactacggtccccttcgttagggtaactttcccgtaacccttttaccggaacggtaccttaaaaccgttagtacggggtacctaagtttccggacctaaccggtttccggggggttacccccggcccggtaaccgggttccccgttacccggggacgggacccggggtaaaacgggggggcccgttacggggggtaagggtttacggggggttcgggaacccggtttaagggtttaaacgttacgttacccggaaagttacggtagggttaaacggttaacggggggtaaacgggtttacggggttttaacgggtaaaggggttaaacgggttttagttaacccgggacggtttaaaccgggaacccggtttaccgggttaacggggggtaaacccggggtaccccgggttaaccgttttaaaccccgaaccgttaaacgttcccgttaaacccggaacgggtaaacggtaacctaaacgttaacccgaaaacggtaaaccaacctaaccgttactacttaccgtcgtaaactaaacgaacgtaacctaacgtccgtaagaaacgacgtacgggtacgtaccgtacggtacgttaggtacgttacgttaccgtacgtacggtaccggtaacgggtaaccgggttaacggggtttaggacggtaggtaacgg

SEQ ID NO: 60590 - DNA, 650 bp, Homo sapiens
  misc_feature: GYAE6OF02GQ3Y7.37.8.A08.1.454.CMB.1.raw
  modified_base (171)..(171): a, c, t, g, unknown or other
  misc_feature (171)..(171): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (239)..(239): a, c, t, g, unknown or other
  misc_feature (239)..(239): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
tcagtagtgtagatcacgaccggtgctcgatttagcatactctacagggggtcgtgggagaggagcccagcactagaagtcggcggtgtttccattcggtgatcggcacgtgaacacagaggactcaccatggagttgggctgagctgggttctctgttgcttctttaagngtagccagtntcaggtnctacgtgggcgagtcgtgggggagcggtggtcaggctgggagtcctggtanacttccgcttagagtacgtcctacgttggacttcctacttcgacgtactaacgtagtggacctagtccncgtacgttcgggccncagggcctaccgaggaccggtaagggctagggtgggttggaggtctaagttacagtgaacgtagtcgagtacgaggtctagnggtacgtncgntacggtctagnggtagtacgtntacgactcgtactacgagaacgactaaacgtacgaaacaacgacctaacgtcttaactacgtaggtaacctaaacgtagtaaacctcggtaccttaacggaagttaacccgagtaaccggtaccgacgggacctttgggtaccttaacggtccgtaaccgttagacgggttaaccggaacgggtttagggtaacggttacggtaacggtcgg

SEQ ID NO: 60591 - DNA, 766 bp, Homo sapiens
  misc_feature: GYAE6OF02JUDPI.37.8.A08.1.454.CMB.1.raw
  modified_base (224)..(224): a, c, t, g, unknown or other
  misc_feature (224)..(224): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtagggtcttccgtcgttgccttacgtttaagaggtgtccagttgtcgaggtgacaccgtgggtagagttcggtagggggngtcgtggtaccaggccgtggggaccgggttcccctgacgtccgttccgtaccttgtaacgtcggcccttcggttaggtacttccctaaccgtttccgaacgtacctaaaccttaaggttcggacctaacgtcgtaccctaacggttcccggggtacccgccgtacgggtcctaaccggacggacggtacgggggtccttaagggaggggttcgggagggtacccgtaaggttacttaacgacgtagtaaagtggtaacgtaagggtaatttggttaggagtacgtagacgtcgtaagtcccgtaccgggtaggaacggtcccgtaagttaccgacctacgtctaaccgtagtaaccggacgttaacctaaccggtaacgaaccttacctacgtacgttaccgtactacgaacgtaacgtacgaacgtcgtaacccgagaccgtaagtaccgacggtaccggttacgtgtcgggtaattaccgtagttaccggtaagaggttaacggggttaacgggtacggtttacggaggttaccgtacgg

SEQ ID NO: 60592 - DNA, 575 bp, Homo sapiens
  misc_feature: GYAE6OF02H6QNN.37.8.A08.1.454.CMB.1.raw
  modified_base (169)..(169): a, c, t, g, unknown or other
  misc_feature (169)..(169): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (338)..(338): a, c, t, g, unknown or other
  misc_feature (338)..(338): n is a, c, g, or t
  modified_base (381)..(381): a, c, t, g, unknown or other
  misc_feature (381)..(381): n is a, c, g, or t
  modified_base (435)..(435): a, c, t, g, unknown or other
  misc_feature (435)..(435): n is a, c, g, or t
  modified_base (458)..(458): a, c, t, g, unknown or other
  misc_feature (458)..(458): n is a, c, g, or t
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
  modified_base (528)..(528): a, c, t, g, unknown or other
  misc_feature (528)..(528): n is a, c, g, or t
  modified_base (567)..(567): a, c, t, g, unknown or other
  misc_feature (567)..(567): n is a, c, g, or t
tcagtagtgtagatcacgaccggtgctcgatttagcatactctacagggctgggagaggagcccagcactagaagtcggcggtgtttccattcggtgatcggcactgaacacagaggactcaccatggagtttgggctgagctgggtcttcctcgttgctcttttaagnggtgtccagtgtcaggtcgcaccgtggtggacgtgtggggggagcgtggtccagccgtgggacgtcctgaagctctctgtangcctntggattcaccgttnagcaactntggcntgacncgtcgggccacaggtccacgaggcgaagggttcctggagtgggtcggaanggttaccagtcagagtgagttccggaagtggtaggaggtaatntccggacaggtacccttggagaacgggcctaatccaacgcttcacgagacgtanacggttaccaataacaccgtaancctaagtcctgaacttaanacggaactacgactggaanaaactcggaagttaccgaccgtgttgaacgtntcccgatacggtcaacgggttaaccgtaagggggtttanagtgtacg

SEQ ID NO: 60593 - DNA, 735 bp, Homo sapiens
  misc_feature: GYAE6OF02IBGKA.37.8.A08.1.454.CMB.1.raw
  modified_base (171)..(171): a, c, t, g, unknown or other
  misc_feature (171)..(171): n is a, c, g, or t
  modified_base (188)..(188): a, c, t, g, unknown or other
  misc_feature (188)..(188): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (518)..(518): a, c, t, g, unknown or other
  misc_feature (518)..(518): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttcctgttgcttactttaagnggtgtccagtgcaggtnacacgtgggtggagtcggtggggagcgtggccaggccgtgggacgtccctggacgactctccgtagttactacggacctcgtaggtattacctacccttcgaacggacctaaacgttaagtcggacctaagttccgaccgtaggtccgggttcccgaccgtaacggccctaaccggacgggacggtaaacggggcttaggggaacgttgggtaacggtataacgtttaanacgttcgaaagtnttacggagtaggaagttcggttaagacggtattagtcgacgtacgcgtacggtaggaacgggtctactaccgactacgtctacgaanaccgtaactaaccgttacgaaacgaactaaccgtacgtccgtacttacgtaaacggaacgtaacgtaacgggtaaactaccggaaaccgtttacgaaacgggtacgttaacgggtaacgaccggttaacggtacctttaaagtaaccgttttaggacggttacggtaaacggtacggtaaccggttttcccaacgggttaccctacgtagtaaccgg

SEQ ID NO: 60594 - DNA, 691 bp, Homo sapiens
  misc_feature: GYAE6OF02GLF9H.37.8.A08.1.454.CMB.1.raw
  modified_base (170)..(170): a, c, t, g, unknown or other
  misc_feature (170)..(170): n is a, c, g, or t
  modified_base (257)..(257): a, c, t, g, unknown or other
  misc_feature (257)..(257): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtcttcctcgttgctcttttaagnggtgtccagtgtcaggtgcactggtggagtcgtggggagcgtggccagccgtgggacggtcctgacgctcgtcctgtatacgtcctntggtattccaccttcagtcctaactgtggcagtgctaacgtcgggtccgccgtaggtcctccggagggacgaacgggggtctaggggtagggttcggggtagggcgtaagttttaacgtacgtacggagtaacgtggtaaggtgggtaaaggttcggtttagggaacgggtaggttagtcggacgtaacgtacccggtacggtacgggaaccggggtaccgtacttaccgacctacgttccgtaccgaacgaaccgtagtaacgttaccgaaaacgaactaacccgtaactccgttaacgtctacggaacctaaaggtacaaccggtacgtacccgtaagtaacgtaaacgtaggaacggtacgaccggtagtgttaacgtactaccgtacgtgtacggaaccggttaacggtaggggtacgtacggtgtacgg

SEQ ID NO: 60595 - DNA, 710 bp, Homo sapiens
  misc_feature: GYAE6OF02G3E9A.37.8.A08.1.454.CMB.1.raw
  modified_base (191)..(191): a, c, t, g, unknown or other
  misc_feature (191)..(191): n is a, c, g, or t
  modified_base (283)..(283): a, c, t, g, unknown or other
  misc_feature (283)..(283): n is a, c, g, or t
tcagtagtgtagatcacgaccggtgctcgatttagcatactctacaacacaacaaaggggctgagagaggagccttagccctggattccaaggcctatccacttggtgatcagcactgagcaccgaggattcaccatcggaacgtggggctccgctgggtttcctgttgctatttagagtgtccagtgtgnggtgcagcgtggtggagtcgtgggggagccgtggtcaagccgtgggacgtcctgagactctcgtgtgcagcctcttcggacttcgacccttnagtgctagtgacagtgaacgtcgggtccgaccgacggcctaccggaagggggacggggacgtgggtaggtcggggtctcgtacgttaccgtaagtttacggaggttacggttacggtaacttaacgtattaacgtaccgtaacgacctacgtacgtcggtaacggtacggacggggtacctaacgttacccgaccgttaacgtccgttaccgaaagtaccgaaccgtaaccgaaccgtaaacgtaacctaccgtacgtacgttaacgtccgtaacgtaacgtaacgtaacgaacgtacgttacgacggtaaacggacgggaacccgggacggaacggacccggtacggttacggttaagtttaaccgttacgttaggttacggacggtacccggtaacccgtccccctaccccggactaaccccggg

SEQ ID NO: 60596 - DNA, 688 bp, Homo sapiens
  misc_feature: GYAE6OF02JUDZZ.37.8.A08.1.454.CMB.1.raw
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtgggtcttcctgttgcttcttttaagaggtgtccagtgtcgaggtcgctaccgtggtggagtcgtgggggacggtcgtaggtccagccgtggggacgtcctggagactctcctagtactcgccttcgaggtacttaccgaccgtttcaaggctaacgtatcgggtcatcgctacgtcgggtcccgacacggctccggaggtcgaacggggtctaggcggtgggtacgcgttagtagtactacagtacgtagtcgtaggtaggttcggttagaggtaacgttagtacgcgtaaccggtaccggttacggacgggaacgggtcctacgttacgacctacgtacctacgaagtaactaactacgtaaacgaaccggaaactaccggaactttagtaactacgttagaaactacgtaaacgaaccgcgtaacgtagtaacgaacgttacgggacctacggtacgtcgttaacggtacttacgtaccgtaacggtcttaaacggggccggttaaacgggttaacggggtaacgttaggaccgtacgggg

SEQ ID NO: 60597 - DNA, 660 bp, Homo sapiens
  misc_feature: GYAE6OF02IRUUJ.37.8.A08.1.454.CMB.1.raw
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (180)..(180): a, c, t, g, unknown or other
  misc_feature (180)..(180): n is a, c, g, or t
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (519)..(519): a, c, t, g, unknown or other
  misc_feature (519)..(519): n is a, c, g, or t
  modified_base (570)..(570): a, c, t, g, unknown or other
  misc_feature (570)..(570): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagctgggtctctcgtgcttctttaaggngtntcgagtgtnaggtgctaccgtgggtggagtcgtggggggagcggtggtccaggccgtggggtacggtccctgacgtctcctccgtgtancgtcctgtggtatctaccttnacgcaactgtcggcatcgcacgtcgggtccgctacgggtcctaccggagggacggaaggggtcgtagggtaggggttcgggnggtcgtaaggttanatacgagtatagggatagggtagttgtaggaagtagtacgtagacgtggtaccgttcggaggtacgggtactacggtaccacgacgttcacgacggtacgtaacctaagttaacccgaaataacccgattacctaaccgttntaccgctaaactaacgtaacaacggaacgttaccgtaaggaacgtaaccgnggaagtacccgcgttacggtagttaccgttagactacggttcgtaccgggttaacggaaccgggtttaggggtaagtacgtcggtaacgg

SEQ ID NO: 60598 - DNA, 774 bp, Homo sapiens
  misc_feature: GYAE6OF02HV36T.37.8.A08.1.454.CMB.1.raw
  modified_base (174)..(174): a, c, t, g, unknown or other
  misc_feature (174)..(174): n is a, c, g, or t
  modified_base (195)..(195): a, c, t, g, unknown or other
  misc_feature (195)..(195): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggtagtttgggctgagcgtgggtcttcctcgttgcttacgtttaagnggtcgtcctagtgtcgaggtnccgtaccgtgggtggtagtcgggtggggggacggtcggtcggtaccaggtccgtggggtacggtccctggaggtaccttccgtccgttaggtataccgtccgttcgtcggtaacttaccgtacccgttgaacgtacctaaacgtgtcggtacaggttcgaccgtccggttacgggccccgtccgtaacggccgttaccggaacgggtacggaacgggggttccgttagggtaccggggttggggtaccgtacgtaagtttacggttacgacgtaacggtagttaacggtaggttcgggtaaaggtttggtaggggagttacgttagacgtacggaaacgttccggtacggaaggtaacccgggtcgtaaccgtccgtaacctacgttaccgacgtaacggaactaaccgtaacgtaaccaaacgaacctaacctacgtactaccgtaacgtacggaactaacgtaccgacacggtccgaacgacttaacggagtacgaccggtagtacgtcgtaactcgtaacgtacgtacggtaccggtaaccggttaacggggttacggtaagtacggacgttacgg

SEQ ID NO: 60599 - DNA, 788 bp, Homo sapiens
  misc_feature: GYAE6OF02FRQV6.37.8.A08.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
tcagtagtgtagatcacgaccggtgctcgatttagcatactctacaggggctgggagaggagcccagcacgtagaagtcggcggtgtttccattcggtgatcggcactgaacacagaggactcaccagtggtagtttgggctggacgcgtgggttccttccgtcgttgtcttacgtttttaaggaggttcgtccagtcgtcgaggtcgactacgtggtggagtcggnggggagcgtgtacncgcgtagggcgttccnggacacgttcctcgtagtactacgtccttcggttggtacttccgtacctttacgacgactaacgtagcgccgtagtcgaccgtacgtccgggtacctccggacgtccacgcggacgtaacgggcgtagggtaggtgggtacggtacgtaggttactacgtagtacgggtactagggtaacggtttagggtacgttgggttaaggaacggttgtaacgtacggcgtaacggtaccggtacggtagggtacggtaccgtacgttaccgacgtactaccgtacgacggaacgtaccgtaacgttaacccgaagtaaccgtacctaaccgtttactaccgttacgaacgttaacgaaacgttaaccgaaccgtaccgtacccggtaagttaaacccggacggttaacggtaacccggacggtacccggtaggttaacggtaccttaacggttacccgtaggtaccggggttaaccgtaacccgggggttaacggggttaacgggggtttacgaaccgggttaggttaaacccggg

SEQ ID NO: 60600 - DNA, 670 bp, Homo sapiens
  misc_feature: GYAE6OF02GZNH6.37.8.A08.1.454.CMB.1.raw
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
tcagtagtgtagatcacgaccggtgctcgatttagcatactctacagggggctgggagaggagcccagcactagaagtcggcggtgtttccattcggtgatcggcactgaacacagaggactcaccatggagtttgggctgagctgggtcttctgttgctctttaagngtntccagtgtcgagtgactacgtggtgagtcggtggggagcgtgccagccgtgggcgtccnggacgactctctgtatnctctgacttcacttnagacaactgcggcatcgactacgtcgggccnccgtaggcctacgaggacggacgggtcgtagggcggtgggtcggatacggtttatntacgagtagtaggagttaggtaacggtgttaagggacggtagttagtcgtaacgtacgtacgttccgggtagggaaccggtaccgtacgttacccgaaccgtagttacccgacgtaagaaccgtaacctaaacttacgaaacgaacctacgtactacctagttacagaaacttacggaaactaccggaacgtccgtaaggtaactaacgggtagaaccggtaccggaggtacgttaacgggtaactttacggccttaaaccgggtcggtaaccgggttaaccggaaaccgggggtttaggggtaaccgtagaccgttcggg

SEQ ID NO: 60601 - DNA, 626 bp, Homo sapiens
  misc_feature: GYAE6OF02ITQLO.37.8.A08.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
tcagtagtgtagatcacgaccggtgctcgatttagcatactctacaggggcgtgggagaggagcccagcactagaagtcggcggtgtttccattcggtgatcggcactgaacacagaggactcaccatgggagtttgggctgagcgtgggtcttccgcgttgcttctttaagaggtgtccagtgtcgaggtgcacgttggnggagtcgtggggagcgtggtccagccgtgggaggtccctgaagcctctccgngtaatcgcctgtgattcacttnagacatagtgctatcgcagtcggggtacccncgacggtcctaccggaaggtaccgtaacggggtcgtgggtacgggtcgggtacgtataacggttagtcgtaacgtaggtagtaacggaggttagggtaaggttggttacggaacggttcgtacgtcgaccgtacggtaccgtaccgggtaggaccggtctacgtccgactacggtccgacgaagaacgtacgtaaccgtacgaaacgactaccgtactacgaacgtcgacgaactacgtacacgtacgcgaagtacagtacgacgacgtcggtacgtgtacgactgacgtgacggaccggaggttagggtcgacgtgtcg

SEQ ID NO: 60602 - DNA, 702 bp, Homo sapiens
  misc_feature: GYAE6OF02HVH1A.37.8.A08.1.454.CMB.1.raw
  modified_base (171)..(171): a, c, t, g, unknown or other
  misc_feature (171)..(171): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagtagtgtagatcacgaccggtgctcgatttagcatactctacaggggctgggagaggagcccagcactagaagtcggcggtgtttccattcggtgatcggcactgaacacagaggactcaccatggagtttgggctgagcgtgggtcttctcgttgctacttttaagnggtgtccgagtgtcaggtgacacgtggtggagtcgtggggagcgtggtcagcgtgggacggtccngacgtactctcgtgtagtcnccttgtggtacttcgtaccgttcagtactactagtcggcgtagttcgaccgtcgtacgggtccgaccgtacggcgttaccgacggaccgacgggtcggtggtggggtacggtcggtaccgttaggttaacttataccgaggtacttaggtaggtacgggttaagttagggttacggtaggtacgttagtacggcgtaaggtaacccggttcggtaacgggtacgggtcgtaaccgtaccgtacacgtccgtaccgtagacggtaactaacgttaaccgaactaaacgctaccgtctacgtacaacgtaacgtaacgtaacacgaccgtacgacgtaaacgagtaccgacggtaccgcggtaccgttggtaaccgtagttacccgtaggtaaccggttcgtaacccggggtaagggttacggggtttaaacgtcgggtaacgtcggg

SEQ ID NO: 60603 - DNA, 501 bp, Homo sapiens
  misc_feature: GYAE6OF01D8F3T.37.74.G08.1.454.CMB.1.raw
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgagtcactaaacggcctcaggagtttcaatcgcttctctggctccaagtctggcaacacggcctcctgaccatctctgggctccaactgagacgagctcactatattgcagctcatatacaagcagcgtcacgttgggtgttcggcggacgggaccgacgtgaccgtcttaggtcagcccaaggcctgtcccccg

SEQ ID NO: 60604 - DNA, 510 bp, Homo sapiens
  misc_feature: GYAE6OF01BOP6O.37.74.G08.1.454.CMB.1.raw
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccaggcaaacgtcccaaactcataattatgagtcactaaacggcctcgagggtctactaatcgcttctctggctcaagtctggcaacacggcctcctgaccatctctgggctccgaggctgacgacgagctcacttattattgcagctcatatacaagcagcatctacgttgggtcgttcgggagggacgggaccgaccgtggaccgttcgttacggtcacgcccgaaggtcccg

SEQ ID NO: 60605 - DNA, 502 bp, Homo sapiens
  misc_feature: GYAE6OF01B3M3X.37.74.G08.1.454.CMB.1.raw
  modified_base (297)..(297): a, c, t, g, unknown or other
  misc_feature (297)..(297): n is a, c, g, or t
tcagtagtgtagatcacgaccggtgctcgatttagtagctctatcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgctggtggttataactatgtctcttggtaccaacatcacccaggcaaagtccccaaaactcatgatttangaggtcactaaacggccctcagggtctctaatcgcttctctggctccaagtctggcaacacggcctccctgaccatctctgggctccaggctgacgacgaggctcactattattgcagctcatatacaagcagcatcacttgggtgttcggcggacgggaccgactcgaccgtcttaggtcacgcccaaggcctcgccccgtcgg

SEQ ID NO: 60606 - DNA, 507 bp, Homo sapiens
  misc_feature: GYAE6OF01BXYRW.37.74.G08.1.454.CMB.1.raw
  modified_base (261)..(261): a, c, t, g, unknown or other
  misc_feature (261)..(261): n is a, c, g, or t
tcagtagtgtagatcacgaccggtgctcgatttagtagctctatcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaactcataatttatgagtcactaaacggcctcaggagtttcaatcgcttctctggctccaagtctggcaacacggcctccctgaccatctctgggctccaacctgaggacgaggctcactattattgcagctcatatacaagcagcgtcacgttgggtgttcggcggagggaccgaccgtggaccgtcttaggtcagcccaaggcctgtccccccg

SEQ ID NO: 60607 - DNA, 525 bp, Homo sapiens
  misc_feature: GYAE6OF01BGJUI.37.74.G08.1.454.CMB.1.raw
  modified_base (417)..(417): a, c, t, g, unknown or other
  misc_feature (417)..(417): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacagcacccaggcaaagcccccaaaactcatgatttgtgaggacagtaagcggccctcaggggtctctaatcgcttctctggctcaagtctggcaacacggcctccctgaccatctctgggctccaactgaggacgaggctacactatatgcagctnatatacaagcagctcacgttgggtcgttcggcgggtacgggaccgtaccgtgacccggttcttagggtccacggaccccgtaagggccctcggcccccgtgggtaccc

SEQ ID NO: 60608 - DNA, 503 bp, Homo sapiens
  misc_feature: GYAE6OF01D7H7F.37.74.G08.1.454.CMB.1.raw
  modified_base (322)..(322): a, c, t, g, unknown or other
  misc_feature (322)..(322): n is a, c, g, or t
  modified_base (436)..(436): a, c, t, g, unknown or other
  misc_feature (436)..(436): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataattatgagtcactaaacgccctnaggattcaatcgcttctctgctccaagtctggcaacacggcctcctgaccatctctgggctccaactgaggacgaggctcacttattattgcagctcatatacaagcagcgtcncgttgggtgttcggcgggaggaccgaccgtgaccgtcgttaggtcacgacccaaggctcgtcccccg

SEQ ID NO: 60609 - DNA, 505 bp, Homo sapiens
  misc_feature: GYAE6OF01ELKCS.37.74.G08.1.454.CMB.1.raw
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (494)..(494): a, c, t, g, unknown or other
  misc_feature (494)..(494): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcccctgcactggaaccagtagtgatattgaaacttataaccttgtctcttggtaccaacagcaccaggcaaagcccccaaactcatgatttgtgagacagtaagcggcctnaggggtttctaatcgcttctctggctcaagtctggcaacncggcctcctgacaatctctgggctccaggctgaggacgaggctgattattactgctgctcatatgcaggtattcacttcttatgtcttcggaactgggaaccaggtccaccgttctaagtcagacccaaggcccaacccnctcgtctaccg

SEQ ID NO: 60610 - DNA, 523 bp, Homo sapiens
  misc_feature: GYAE6OF01ERZEB.37.74.G08.1.454.CMB.1.raw
  modified_base (360)..(360): a, c, t, g, unknown or other
  misc_feature (360)..(360): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaaactcataatttatgaggtcactaaacggccctcaggagtttcaatcgcttctctggcctcaagtcnggcaacacggcctccctgaccatctctgggctccaacctgaggacgaggctcactattattgcagctcatataacaagcagcgtcacgttgggtgttcgggcgggagggacccggacctcggaccgtcgttacggtcacggcccaacggcctcggtccccccg

SEQ ID NO: 60611 - DNA, 506 bp, Homo sapiens
  misc_feature: GYAE6OF01CFZE9.37.74.G08.1.454.CMB.1.raw
tcagtagtgtagatcacgaccggtgctcgatttagtagctctatcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaaagtccccaaaactcataatttatgaggtcactaaaacggcctcaggagtttctaaatcgcttctctggctccaagtctggcaacacggcctccctgaccatctctgggctcaacctgagacgaggctgattatactgcagttcatatagagcgacacacttatgtcttcggaagtgggaccaaggtcgtcgtcctaagtcagcccaaggccaaaccccatcg

SEQ ID NO: 60612 - DNA, 654 bp, Homo sapiens
  misc_feature: GYAE6OF01EPROQ.37.74.G08.1.454.CMB.1.raw
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
tcagtagtgtagatcacgaccggtgctcgatttagtagctctatcagggggggtctcaggaggcagcgctctcaggacatctccacatggcctgggctctgctgctcctcaccctctcactcagggcacagggtcctgggcccagtctgccctgactcagcctgcctcgtgtctgggtctccgtggacagtcgatcaccatctctgcactggaaccngcagtgacgttggagttataatatgtctntggtaccaantcacacntcaccaggcaacgtcccaaatcaatattangaggtcacgtaaacgcctagaggtactttacaactcgtcttcgtactcggtcctacgtaacgttccgtacggtacctaaaccgtaccggtttcctacccggttagacccgttaagttccgttaccgttcggggtacccttacccggtaaaccgttggaacggtaccgtacggttaccctacgtaacgttacgtttacgttcggactacggtctacgtattacgtaactagcgtaacggtccttacgtaacgtttcgggtacgtacgggtaccggtaacgggtaccctacggttcggtacccggttagttaccgggtaccacgggtaccccgtaagggttcccttaccgggttaccccccgg

SEQ ID NO: 60613 - DNA, 524 bp, Homo sapiens
  misc_feature: GYAE6OF01EZR65.37.74.G08.1.454.CMB.1.raw
  modified_base (421)..(421): a, c, t, g, unknown or other
  misc_feature (421)..(421): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccccgcagtgacgtttggtggttataactatgtctcttggtaccaacatcacccaggcaaagtccccaaactcatgatttatgaggtcactaaaacggccctcaggggtctctaatcgcttctctggctcaagtctggcaacacggcctccctgaccatctctgggctccaggctgacgacgaggctcactattattgcagctnatatacaagcagcatcacgttgggtgttcggcggagggaccgaccgtggacccggttcttaagggtccaacgcccaaagggccttcggcccccgttgggtccc

SEQ ID NO: 60614 - DNA, 518 bp, Homo sapiens
  misc_feature: GYAE6OF01B989O.37.74.G08.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttangaggtcactaaacggccctnaggagtttcaatcgcttctctggctccaagtctggcaacacggcctcctgaccatctctgggctccaactgaggcgaggctcactattattgcagctcatatacaagcagcgtcacgtttggggtgttcgggcgggacgggaccgaccgtggacccgttcttaggtccacgcccaaggcctcggtccccccg

SEQ ID NO: 60615 - DNA, 492 bp, Homo sapiens
  misc_feature: GYAE6OF01E24E0.37.74.G08.1.454.CMB.1.raw
  modified_base (316)..(316): a, c, t, g, unknown or other
  misc_feature (316)..(316): n is a, c, g, or t
  modified_base (489)..(489): a, c, t, g, unknown or other
  misc_feature (489)..(489): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaactcatgattgtgaggacagtaagcggccctnaggggtttcaatcgcttctctggctccaagtctggcaacacggcctccctgacaatctctgggctccaggctgaggacgaggctgattatactgctgctcatatgcaggtatcactcttatgtcttcggaactgggaccaaggtcaccgtcaagtcagcccaagcccaacccntcg

SEQ ID NO: 60616 - DNA, 530 bp, Homo sapiens
  misc_feature: GYAE6OF01AMY2L.37.74.G08.1.454.CMB.1.raw
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcaccaacatcacccaggcaaacgtccccaaactcataatttatgagtcactaaacgcctcgaggtatttctaatcgcttctctggctcaagtctgcaacacggcctcctgaccatctctgggctccaactgaggacgaggcctcactattatgcagctacatatacaagcagtccgtctacgttgggtcgttcgggcgggtacgggtacccgaccgtggacccgttcgttacggtcacggaccccgaaggccgtccggtccccccg

SEQ ID NO: 60617 - DNA, 497 bp, Homo sapiens
  misc_feature: GYAE6OF01DAB2I.37.74.G08.1.454.CMB.1.raw
  modified_base (303)..(303): a, c, t, g, unknown or other
  misc_feature (303)..(303): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttaataaatatgtctcttggtaccaacatcaccaacatcacccaggcaaagtcccaaatcataatttangagtcaactaacgcctcaggatttctaatcgcttctctggctccaagtctggcaacacggcctcctgaccatctctgggctccaactgaggacgaggctcactattattgcagctacatatacaagcagctcacgttgggtgttcggcggaggaccgactcgaccgtgttacggtcacgccaagctcgtccccg

SEQ ID NO: 60618 - DNA, 526 bp, Homo sapiens
  misc_feature: GYAE6OF01EGPTS.37.74.G08.1.454.CMB.1.raw
  modified_base (428)..(428): a, c, t, g, unknown or other
  misc_feature (428)..(428): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtacaacatcacccaggcaaagtccccaaactcatgatttatgaggtcactaaacggccctcaggggtctctaatcgcttctctggctccaagtctggcaacacggcctcctgaccatctctcggctccgaggctgacgacggacggctacacttattattgcagctcaatanacaagcagcgtcacgttgggtgttcgggcggacgggaccgaccgttggacccgttcgttacggcacggtcccaaggcctcggcccccgtcggtacccg

SEQ ID NO: 60619 - DNA, 523 bp, Homo sapiens
  misc_feature: GYAE6OF01EL9NY.37.74.G08.1.454.CMB.1.raw
  modified_base (424)..(424): a, c, t, g, unknown or other
  misc_feature (424)..(424): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcaccaacatcacccaggcaaagtcccaaactcataatttatgagtcactaaacggccctcaggagtttctaatcgcttctctggctccaagtctggcaacacggcctccctgaccctatctctcgggctccaacctgacggacgaggctcactattatncagctcatatacaagcagcgtctacgttgggtcgttcgggcgggacgggacccgactcggaccgtcgttacggtcacgacccgaggccgtcgtcccccg

SEQ ID NO: 60620 - DNA, 514 bp, Homo sapiens
  misc_feature: GYAE6OF01AR8YS.37.74.G08.1.454.CMB.1.raw
  modified_base (220)..(220): a, c, t, g, unknown or other
  misc_feature (220)..(220): n is a, c, g, or t
  modified_base (484)..(484): a, c, t, g, unknown or other
  misc_feature (484)..(484): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataaatatgtctcttggtaccaacatcaccaacatcacccaggcaaagtccccaaactcataatttatgaggtcactaaacggcctcagggtctactaatcgcttctctggctccaagtctggcaacacggcctccctgaccatctctgggctccaacctgaggacgaggctcactattattgcagctcatatacaagcagcgtcacgttgggtgttcgggcgggacgggaccgaccgtgacccgtnttacggtcacgcccaaggctcggtcccccg

SEQ ID NO: 60621 - DNA, 739 bp, Homo sapiens
  misc_feature: GYAE6OF01DN2AS.37.74.G08.1.454.CMB.1.raw
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcacgtcggaacccnagtgacgttggtagttaatactatgtctctggtacaacatcaccagacaaacgtacccaaactcatgtatttangagtacaactaacggcctacgacgggtctactaactcgtcttcgtctcggtcctaccgtaagtcgtacggacaaccgtaccggtacctcccgttacgaaccctacgttccgttccggtcggggtccttacccggaacgggtccgttaacgggaaccggtaacgggtaccgggtacccttaccgtaacgttttaacgtttaacgtttcgacctaacggtacttaacctaagttaacgtaaaccgaacgacctaacggtacctacgttaaccggttacggtttacgggggttcggttaccggggaccggggtaaaccgggtaccccggttaacccggttaccgggttaacccggtttcggttaaccgggttacccgaacccgggtaccccggtaaacgggccccgtttaccccggtccccccggttaccgggtttacccccg

SEQ ID NO: 60622 - DNA, 660 bp, Homo sapiens
  misc_feature: GYAE6OF01D3O6A.37.74.G08.1.454.CMB.1.raw
tcagtagtgtagatcacgaccggtgctcgatttagtagctctatcaggggggggtctcaggaggcagcgctctcaggacatctccaccatggcctgggctctgctgctcctcaccctcctcactcagggcacgagggtcctgggcccagtctgccctgactcagcctgcctccgtgtctggtctcgtggacagtcgatccacatcctcctgcactggaaccagcaggtgacgttggtagttaataatatgtcttcttaggtaaccaactataccaaccaacactaccaaccccaggaccaaaacgtaccccaaactactaattaatttagtagtacggtaccaaacgttaaaccggccccttagagggtatttacctaatcgtcttctctggtcctaccgtaagtcctaggaccaaccgaccgtcccttacccgtacgacctactccgttacgtcgggtcccttacccgaaccgtggaaccgggacgtacggtcctacgtacttaagttacttcgacctagtcctactaataactaacgaagcacgtcgttcgtagttcggggtcgttaccgggcgggtaaccgggacccgtacccgtggaaccccgtttggttacggtaccaccggtaacccggtacggtccgtccccggtaccccccg

SEQ ID NO: 60623 - DNA, 781 bp, Homo sapiens
  misc_feature: GYAE6OF01BGCKZ.37.74.G08.1.454.CMB.1.raw
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtttggtagttataactatgtctcttaggtaaccaacatccaccaggacaaacgtaccccaaactcatgtatttatgaggtcaactaaacggcctacgtagggtttctaatccgtcttctcgtcggctaccgtaagtcgtcggaccaacgaccggtaccctcccgtagtaacaacgttccgtacgtcgggtaccttaccgacggtacgtaggaacgggacgtaacgggtccttaggttaacttttaacgttaacgtcggttaccctggtaccttaaccgtaagtttacgtacggttaccggtaacgggtttaaccgtttaccgttaaccgttttacccgttttaaggttaccgggttttacccggttttaacccgggtaaaaccggttaacccggggggtaaacccgtaaaccgggtttaccccgttaaacccccgggtttaaccccttaaaaccggggttaccccgaaaccccgggtaaccccccggtaaaaccccggggtaacccccccctaaaaccccccgtttaaccggttacccggtttaacccccg

SEQ ID NO: 60624 - DNA, 544 bp, Homo sapiens
  misc_feature: GYAE6OF01CZ808.37.74.G08.1.454.CMB.1.raw
  modified_base (246)..(246): a, c, t, g, unknown or other
  misc_feature (246)..(246): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatccaccatctcctgcactggaaccagcagtgacgttggtgttaataaatntgtctcttggtaccaacatcaccaacatccacccaggaccaaacgtccccaaactcaataatttatgacggtacaactaaacggccctagaggtagtttactaatcgtcttctctggctccaagtctgaccacacccggcccctgaccatctcgtcggcctacccactgacggcgaggctacactattattgcagctcatatacagcacgcgtcgtagttgggtcgtcgggcggacgggtaccgaccgtcggtccgtcgttacggcctaacggcccaaggccctccggcccccgtcgg

SEQ ID NO: 60625 - DNA, 591 bp, Homo sapiens
  misc_feature: GYAE6OF01BKIDK.37.74.G08.1.454.CMB.1.raw
  modified_base (309)..(309): a, c, t, g, unknown or other
  misc_feature (309)..(309): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcaccaacatcacccaggcaaacgtccccaaactcataatttangaggtcactaaacggccctagaggtatttctaatcgcttctctggctccaagtctggacaacgacggtccctccctgaccattcctcgtcgggcctccgaacctgacggacgaggcctacacttattattcgctaagtcctacaactaataacgaacgtcgaagccgttaccacgtttcggggtcggttccggggcgggtaacggggtacccgacccggttcggaccccggttcgttaacgggtcacggaccccgaacgggtccgtcccggtacccccccgg

SEQ ID NO: 60626 - DNA, 526 bp, Homo sapiens
  misc_feature: GYAE6OF01DRDGY.37.74.G08.1.454.CMB.1.raw
  modified_base (262)..(262): a, c, t, g, unknown or other
  misc_feature (262)..(262): n is a, c, g, or t
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
  modified_base (431)..(431): a, c, t, g, unknown or other
  misc_feature (431)..(431): n is a, c, g, or t
  modified_base (493)..(493): a, c, t, g, unknown or other
  misc_feature (493)..(493): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttaataaatatgtctcttggtaccaanatcaccaacatccaccaggacaaacgtcccaaatcatatttangagtcaactaacgcctnagtatttcaatcgacttctctggctccaagtctggacaacgacggcctcctagaccatctcgtcgggctaccaactggacggacgaggctacacttattattgcagctnatatacagcagcgtctacgtttgggcgttcgggacggtacgggaccctaccgtgacccgttnttacggccacgacccaaggccgtcgtccccccg

SEQ ID NO: 60627 - DNA, 525 bp, Homo sapiens
  misc_feature: GYAE6OF01DRCGC.37.74.G08.1.454.CMB.1.raw
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctnttggtaccaacatcaccaacatcacccaggacaaagtccccaaactcataatttangagtcactaaacgcctnaggagtttcaatcgcttctctggctcaagtctggcacacggcctcctgaccatctctgggcctccaacctgagcgagctcactattatgcagctcatactacaagcagcgtactacgttgggtcgttcgggacgggacgggacccgtaccgtggacccgttcgttacggtcaacggcccgaaaggcccgttcgtccccccg

SEQ ID NO: 60628 - DNA, 554 bp, Homo sapiens
  misc_feature: GYAE6OF01AI4S6.37.74.G08.1.454.CMB.1.raw
  modified_base (221)..(221): a, c, t, g, unknown or other
  misc_feature (221)..(221): n is a, c, g, or t
  modified_base (368)..(368): a, c, t, g, unknown or other
  misc_feature (368)..(368): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataaatatgtctcttggtaccaacatcaccaacatcacccaggcaaagtccccaaactcataatttatgaggtcactaaacggccctacaggtagtttctaatcgtcttctctggctcaagtctgcaacncggccctcctcgaccatcctcgtcgggccctaccgaacctggacggacgaggtctactactattattgcagtctacatatacaagcagcgtactagttgggtcgttcgggcgggtacgggacccgaccgtggtacccgttcgttacggtccgacggaccccaacgggtcccgtcggtcccccccgg

SEQ ID NO: 60629 - DNA, 773 bp, Homo sapiens
  misc_feature: GYAE6OF01EKNO8.37.74.G08.1.454.CMB.1.raw
  modified_base (315)..(315): a, c, t, g, unknown or other
  misc_feature (315)..(315): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctcctgcactggaaccagcagtgtacgtttggtagttaataaatatgtctcttggtaccaacatcaccaacatccacccaggacaaacgtaccccaaactcataatttangtagtacaactaaaccggccctacgaggtacgtttactaacgtcgtactttctcgtcggcttaccgaagttccgtacgggaccaaaccgtaccgggtccccttaccccgtacggtaacccctaacgttcccgttacgttcccgggggtacccttaccccgtaaacccggttgggaacgggtaaccgggacgggttccctaccgtaacctttaattttaacgttcggtacctaacggtccttaacctaacgttaaacgttaactaaacgggtcccgaaggttacccggttacgtaacccgggttttgggggttacggggtttacccgggggtaccgggggtaaaccgggggtaacccccggttaccggttacgggtaaccccggtttaccggtttaaccgggttaccgaacgggtacccccgtaaacggggtccccttccccggggttaccccccccgg

SEQ ID NO: 60630 - DNA, 646 bp, Homo sapiens
  misc_feature: GYAE6OF01DVEM9.37.74.G08.1.454.CMB.1.raw
  modified_base (225)..(225): a, c, t, g, unknown or other
  misc_feature (225)..(225): n is a, c, g, or t
tcagtagtgtagatcacgaccggtgctcgatttagtagctctatcgagggggggggtctcaggaggcagcgctctcaggacatctccaccatggcctgggctctgctgcctcctcaccctcctcactcagggcacagggtcctgggcccagtctgccctgactcagcctgcctcgtgtctgggtctcctggacagtcgatcaccatcctcctgccactggaaccngcagtgacgttggtgttaataaatatgtctcttggtaaccaacatacaaccaacactaccacccgacggaaccaaaacgtacccctaaaactcctaaattaaacttttagtaggtaacgtaactaaaccgtaaaaccggtcccctacgtaaggtaacgtttactaaagtcgtcttctcgtagtcctactaacgtcgtaggacaaccgacggccctacctacgaccacttctcgtcggcctaccaacgtacggacggacgacggctactacttattaagttcacagtactacaataactacgaacgtcacgtccgttacgtacggttgggtacggttcgggacgggtacgggaaccctaccgtcggaaccgttcgtacgggtaccaacggtacccgaacgggtccgtcccggtaacccccgg

SEQ ID NO: 60631 - DNA, 720 bp, Homo sapiens
  misc_feature: GYAE6OF01AB6W6.37.74.G08.1.454.CMB.1.raw
  modified_base (344)..(344): a, c, t, g, unknown or other
  misc_feature (344)..(344): n is a, c, g, or t
tcagtagtgtagatcacgaccggtgctcgatttagtagctctatcgaggggggggtctcaggaggcagcgctctcaggacatctccaccatggcctgggctctgctgctcctcaccctctcactcagggcacgagggtcctgggcccagtctcgccctgactcagcctgcctcgtgtctgggtctccgtggacaggtcatccaccatctcctgcactaggaaccagcagtgtacgttggtagttaataatatgtctcttacggtaaccaactataccaaccgaaactacttccaacccgagggacctaaaaccggcccctaaaatccgtaatttaaacttttanggtaacggttaccaaaccgtaaacggtccccttagacggttaacgtttacctaaacgtcgtcctttacgtccgtacgggtacctaccgtaaaggttcccgtacgggtaaccaacccggtacccgggtccccttacccgtacggtacccacgtttccgtcggtacgggtaccctaaccgtaaaccgtgggaaacggtaccgacggtacctacctaacgttacttacgtcgaccagtcccttagaattacgacgaatcgacgtcgtaccgtaggttcgggttacggtcccgggacgggtcgggtaacccctacggtccggttacccgttaggtacggtacctaccggacccaacgggttccctaaccggttcccccgg

SEQ ID NO: 60632 - DNA, 549 bp, Homo sapiens
  misc_feature: GYAE6OF01ARP7W.37.74.G08.1.454.CMB.1.raw
  modified_base (359)..(359): a, c, t, g, unknown or other
  misc_feature (359)..(359): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcaccaacactcacccaggacaaacgtccccaaactcataattatgagtcaactaaacgcctcgacgggtctctaatcgcttctctgctcaagtcnggacaacacggccctccctgacccatctcgtcgggctccgaggctgacgacgacggctacactattagttgtcagacctcataactacgaacgacagctagtctacgttcggggtcgttcggggacgggtaacggggacccgaccgtcggacccgttcgttacggtaccgtacggcccgaacgggtcccg

SEQ ID NO: 60633 - DNA, 520 bp, Homo sapiens
  misc_feature: GYAE6OF01B1NA7.37.74.G08.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttgtggttataaatatgtctcttggtaccaacatcaccaacatcacccaggcaaagtccccaaatcataatttangagtcactaaacggccctnagagtttcaatcgcttctctggctcaagtctggcaacncgcctcctgaccatctctgggcctccaacctgacggacacggctcactattattgcagctacattatacaagcagctcacgttgggtgttcgggcggacgggcccgtaccgtgtacccggttcttaacggtccacgaccccgaaggcctcggccccccg

SEQ ID NO: 60634 - DNA, 675 bp, Homo sapiens
  misc_feature: GYAE6OF01CQ06E.37.74.G08.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (354)..(354): a, c, t, g, unknown or other
  misc_feature (354)..(354): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatcaccatcctcctgcactggaaccngcagtgatnttagaaacttataaccttgtctcttggtaccaacagcacccaggcaaacgccccaaactcatgattgtagaggacagtaagcgcctcgtagggtttctaatcgcttctctggctactaagtcnggtacacgacggcctccctagacctaatccttcgtcgggcctaccgagggtcctagggtacggaaccggtacgggcttacgggtaatttaacgtttaacgtcggtacttcgtccttacctaattacgtacggccgtaaaggggtttacgttaccttaaccgttcgttttaacggttacgtttcccgtttaaccggggtaaccgttacgggggaacccttaaacggggttacccctacccggttaacccgttaaaaccggttccgaaccggtaaccccccgaaacgggtacccccccgaaaccccgttccgtttaaccccgg

SEQ ID NO: 60635 - DNA, 633 bp, Homo sapiens
  misc_feature: GYAE6OF01B6I3M.37.74.G08.1.454.CMB.1.raw
  modified_base (227)..(227): a, c, t, g, unknown or other
  misc_feature (227)..(227): n is a, c, g, or t
  modified_base (314)..(314): a, c, t, g, unknown or other
  misc_feature (314)..(314): n is a, c, g, or t
tcagtagtgtagatcacgaccggtgctcgatttagtagctctatcgaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgactcacctatctcctgcacgtcggaaccngcagtgacgttggtagtaataaatatgtctcttggtaacacatcaacaacactacaccaggacaaacgtcccaaactcatgtattangaggtacaactaacgcctgacgggtctctaagtcgcttctctcgctactaagtctgacaacgaccggtcctcccgtacgtaacctacgtccttcgtcggtccttaccgacggtcgtcggaaccggaacgacggtcctactaacttacgtttaagtcgactaacgtcctacgtaacttaactaagaacgcgtaactactacgttaccgttaacgttgggggttacgttccggggaaccgggtacccggggtaaccggtaaccccgttacgggtacccgtttacggttaacggtaccgaacccgggcccggtaaacccggg

SEQ ID NO: 60636 - DNA, 537 bp, Homo sapiens
  misc_feature: GYAE6OF01AMVV9.37.74.G08.1.454.CMB.1.raw
tcagtagtgtagatcacgaccggtgctcgatttagtagctctatcaggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagtccccaaactcataatttatgaggtcactaaacggccctcgagggtctctaatcgtcttctctggctccaagtctggcaacacggcctccctgacccatcctcgtcgggtcctccgaggctgaccgacgacggctcacttattattgcagtctcatataacagcagcatcgtacgttgggtcgttcggccgggagggacccgaccgtggaccgttcgttacggtccacggcccgaggcctccggcccccgttggtacccg

SEQ ID NO: 60637 - DNA, 728 bp, Homo sapiens
  misc_feature: GYAE6OF01AOM2J.37.74.G08.1.454.CMB.1.raw
tcagtagtgtagatcacgaccggtgctcgatttagtagctctatcgaggggggggtctcaggaggcagcgctctcaggacatctccaccatggcctgggctctgctgctcctcaccctcctcactcagggcacagggtcttgggcccagtctgccctgactcagcctgcctcgtgtctgggtctcctggacagtcgatccaccatcctcctgcactggaaccagcaggtgacggttggtagttaataaatatgtctcgttggtaaccaacactaccaaccaacactaccaacccgaggaccaaaccgtaccccaaactctaattaaatttatacggtacggtaccaaccgtaaacccggtccctacgaaggttactttactaactccgtcttacctcgtcggtacctaccgtaacgttccgtacggtacccgtaaaccgtacccggtccccttacccgtacgtaccctaacgttccctaccggttccgggtaccccttaaccccgtaaccgtacgggaaccgggaaccgggtacggtacccttacgtaactttactttacgttacgacctacgtaccttactaacttaactaaccgaacgtcgtaacgtcgttacgtacggttcgggttcgggttccggggacgggtaccgggtacccgtaccggttcggtacccgttacgttacgggtaccgaccggtacccgtacggtcccgtcccggtcccccgg

SEQ ID NO: 60638 - DNA, 576 bp, Homo sapiens
  misc_feature: GYAE6OF01EFT5C.37.74.G08.1.454.CMB.1.raw
  modified_base (315)..(315): a, c, t, g, unknown or other
  misc_feature (315)..(315): n is a, c, g, or t
  modified_base (440)..(440): a, c, t, g, unknown or other
  misc_feature (440)..(440): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttggtaccaacatcaaccaacatccaacccaggaccaaacgtccccaaactcaattaatttangacgtacaacgtaaacggccctacgaggtagtttacaatcgtcttctctggctcaagtctggacaacgacgtcctccctgacctatctcgtggctaccaacgtggacgacgagcctactatattntgacagtctactatactaacgactcgagtacgttcgtacgtttggggtcgtcgggaccgggtaagggtacccgaccgttcggtacccgttcgttaacgggtccacgaccccgaaggtcccttccggtacccccccg

SEQ ID NO: 60639 - DNA, 709 bp, Homo sapiens
  misc_feature: GYAE6OF01A2RK9.37.74.G08.1.454.CMB.1.raw
  modified_base (223)..(223): a, c, t, g, unknown or other
  misc_feature (223)..(223): n is a, c, g, or t
  modified_base (306)..(306): a, c, t, g, unknown or other
  misc_feature (306)..(306): n is a, c, g, or t
tcagtagtgtagatcacgaccggtgctcgatttagtagctctatcaggggggggtctcaggaggcagcgctctcaggacatctccaccatggcctgggctctgctgctcctcaccctctcactcagggcacagggtcctgggcccagtctgccctgactcagcctgcctccgtgtctgggtctcgtggacagtcgatcaccatctcctgcacgtcggaacccnagtcgtacgttggtagttaataactatgtctcttggaccaacatcacccgagaccaaacgtaccccaaactcatcgtatttangtaggtacaacgtaaaccggccctcgacgggtctactaatcgtcttctctcggctccgaagtcgtaggacaacgacggccctaccctgacctactctcgtcgggcctcgaggtctacggacgacggacggtcctacgtaacttattacgttacgaccgtaggtaccttactaagttaaccgtaaccgtaaggacctacggtacctaaacgttccgttaacggttttcggggttacgggttacccggggtaccggggtaaaccgggggtaaccccggtaccgggtttaacccggtaacccgggtttaccgtttaaaccggggtacccaaacccggggttaaccccgtaaaccggggttccccttacccccgggtacccccccggttcgggttaaacccccccgg

SEQ ID NO: 60640 - DNA, 792 bp, Homo sapiens
  misc_feature: GYAE6OF01EJR55.37.74.G08.1.454.CMB.1.raw
  modified_base (228)..(228): a, c, t, g, unknown or other
  misc_feature (228)..(228): n is a, c, g, or t
tcagtagtgtagatcacgaccggtgctcgatttagtagctctatcagggggggggtctcaggaggcagcgctctcaggacatctccaccatggcctgggctctgctgctcctcaccctctcactcagggcacgagggtcctgggcccagtctcgccctgactcagcctgcctcgtgtcgtgggtctccgtggactagtcgatcaccatcctcctgctactcggaaccngctaggtgtacggtttggtagttaataattatcgttctacgttacgtacctaactactaccaaccaactactaccgaacccgtaggacctaaaaccgtaccccaaaactctaaactttaagtttacgtaggtacgtacctaaacgtaacccggtcctaggtacggttacgtttactaacgtcgttacttacgtcgtcggtaccttacgtaacgttcggtaccggaactaacccggtcccggtacccttacccggtacgtacccgttaacgttcccgttacggtacccggtacccttaacccgaacggttacgggaaccggtaccgggtacggtacccttacgtaacccgttttagttaccgttacggaccgtacgttaccgttaactaacgtaacgttaaccgaacggttccgtacggtaccgttacggttaccggtttgggtccggtaccggggtacgggtaacccgggtacccgtacggttaccggggtaacccgtttacccggttaacgggtacccgaccgggtaacccggttacggtccccgttccgggtacccccccgg

SEQ ID NO: 60641 - DNA, 889 bp, Homo sapiens
  misc_feature: GYAE6OF01BUZZR.37.74.G08.1.454.CMB.1.raw
  modified_base (225)..(225): a, c, t, g, unknown or other
  misc_feature (225)..(225): n is a, c, g, or t
tcagtagtgtagatcacgaccggtgctcgatttagtagctctatcgaggggggggtctcaggaggcagcgctctcaggacatctccaccatggcctgggctctgctgctcctcaccctctcactcagggcacgagggtcctgggcccagtctgccctgactcagcctgcctccgtgtcgtgggtctccgtggacagtcgatcacctatctcctgcactggaaccngctagtgtacggttggtagttaataaatatgtctcttaggtaccaacatacaaccaacactaccgaacccgaggaccaaaacgtccccaaaactaccaattaaatttataggtacgtacaaccgtaaaccggtcccctagaaggttacgtttactaacttccggtcttacttcgtacggtccttaccgtaaacggttccgttacgggaacctaaacccggtacccgggtaccccttaccccgtacggtaaccccttaacgtttcccgttacccgggttaccgggtaccccgttaaccccgtaaaacccggtttacggggtaaaccggggaacccgggtaaaccggggttaccccgttaaacctttaaaccccgtttaagttttaacgtttacgggaaccttaaccggttacctttaacccggtaaatttaaacccggttaaaccgtaaacgggacccgttaacggtaccccggttaccggtttaacgggtttttcggggggttaccggggttttacccggggaccggggggttaaacccggggaacccccggttaaccggttcccggggttaaaccccgggtttaccggtttaaaccgggttacccgaacccgggtaccccggtaaaccgggtcccgtttaacccccgggttaccccccccggg

SEQ ID NO: 60642 - DNA, 603 bp, Homo sapiens
  misc_feature: GYAE6OF01E5MEM.37.74.G08.1.454.CMB.1.raw
  modified_base (134)..(134): a, c, t, g, unknown or other
  misc_feature (134)..(134): n is a, c, g, or t
  modified_base (193)..(193): a, c, t, g, unknown or other
  misc_feature (193)..(193): n is a, c, g, or t
  modified_base (309)..(309): a, c, t, g, unknown or other
  misc_feature (309)..(309): n is a, c, g, or t
tcagtagtgtagatcacgaccggtgctcgatttagtagctctatcgaggggggggtctcaggaggcagcgctctcaggacatctccaccatggcctgggctctgctgctcctcaccctcctcactcagggcacngggtcctgggcccagtctgccctgactcagcctgcctccgtgtctgggtctcctggacngtcgatcacatctcctgcactggaaccagcagtgacgttggtagttataaatatgtctcttggtaccaacatcacaacatcacccaggccaaacgtccccaaactcaataatttangagtcacgtaaacgcctgaggtagttctaatcgtcttctcgtggctaccaagtcgtggacaacgcggccctccgtgacctacgtctcgtggcctaccaacgtggaacggaccgaggtcctaccgtaacttacttagttcgctacggtctaactagtaactaacaagcgtagtccgttacgtacgtttgggggtaccgtcggggtaccgggaacggggtacccgaccgttcggaaccccggttgttaccgggtaccacggaaccccctaaggggtccctcccggtacccccccgg

SEQ ID NO: 60643 - DNA, 588 bp, Homo sapiens
  misc_feature: GYAE6OF01AK8FW.37.74.G08.1.454.CMB.1.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagtagtgtagatcacgaccggtgctcgatttagtagctctatcaggggggggtctcaggaggcagcgctctcaggacatctccaccatggcctgggctctgctgctcctcgccctcctcactcagggcacagggtcctgggcccagtctgccctgactcagcctgcctccgtgtctgggtctccgtggacagtcgatcaccatctcctgcactggaaccngcagtgacgttggtgttaataatatgtctcttgtaccaantcacacntcaccagcaagtcccaaatcataattangagtcactaaacggcctanaggtagttactaatcgtcttctctcgctccaagtctggaccaacgacggccctcctgacccatcctcgtcgggcctaccgaaccgtggaacggacgacggtcctacaacgtttactttagttcgaccgtacggacttacaattaacgttaacaacgcctaacggtccgtacgttacggttcggggttacggttccggggacgggttacgggacccgtaccgtcggtacccgttgttacgggccacggacccacggtccgtccggtacccccg

SEQ ID NO: 60644 - DNA, 744 bp, Homo sapiens
  misc_feature: GYAE6OF01EXZ33.37.74.G08.1.454.CMB.1.raw
  modified_base (314)..(314): a, c, t, g, unknown or other
  misc_feature (314)..(314): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtttggtagttataaatatgtctcttggtaccaacatcaaccaacatccaacccaggacaaacgtccccaaactcaataatttanagaggtacaactaaaccggccctacgaaggtacgttttactaaattcgtctttctcgttcggacctaccgtaaagttccgtacgggaccaaaccgtaccgggtccccttaccccgtacgaacccctaagttcccgttacggtcggggtcccttaaccccgaaacccgttacgggaacgggtaaccggacgggtacccttaccgtaaccgttttaacgttttaactttacggaccttaacggtcccttaacgtaaacgttaacttaaaccgaaacggtacctaacggtacctaaacttccgtaaacggttttcgggggtaccggtttacggggaccggggtaacggggtaccccggtaccgttacggtaaccccggtttacgttaacgggtaccaaccgggtaccccgaaagggtccccgttacccccggg

SEQ ID NO: 60645 - DNA, 596 bp, Homo sapiens
  misc_feature: GYAE6OF01ED3HG.37.74.G08.1.454.CMB.1.raw
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtcggaacccgcagtgacgtttggtagttataactatgtctcttggtaccaacatcaccaggacaaacgtccccaaactcatgtatttatggaggtacactaaaccggcctcgagggtctactatcgcttctctggctcaagtctggacaacgacgcctcctagacctatctcgtcggcctccgagctagacgacgaggctacgtacttattattcgactagtcctactaagtaactaacaagccagtactacgttctacggtttggggttacggttccggggacgggaaccggggtaacccgtaccggtacggttacccggttcgttaacggtaccaaccggacccgtaacgggcccgttaccgcccccgttccggtacccg

SEQ ID NO: 60646 - DNA, 606 bp, Homo sapiens
  misc_feature: GYAE6OF01BH5Y1.37.74.G08.1.454.CMB.1.raw
  modified_base (193)..(193): a, c, t, g, unknown or other
  misc_feature (193)..(193): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctcgtgtcgtgggtctcctggacngtcgatccaccattcctcctgcacgtggaaccagcaggtgacggtttggtagttaataaatatgttctcttgtaccaacatcaccaacactccacccagacaacgtacccaaactcattaattatgagtcaactaacggcctacgaggtacgtttactaatcgtacttctacgtcgtacctacacggtctcggaccaaccgtaccgtaccctacctacgaccctacttccgtacggtcgggacctacccgaccgtaggacggaacggtacggtacctacttattactttatcgtacacgtctactagtataacgaagtcagtctacgtggttgggttcggtcggacgggcgggaccctacgtcggtaccgttacggtacggtcaccggtaccgaacgtccgtccggtcccccg

SEQ ID NO: 60647 - DNA, 613 bp, Homo sapiens
  misc_feature: GYAE6OF01AR5ON.37.74.G08.1.454.CMB.1.raw
  modified_base (221)..(221): a, c, t, g, unknown or other
  misc_feature (221)..(221): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttaataaatatgtctcttggtaccaacatcacaacatcaccaggcaaacgtcccaaactcataatttatgagtacaactaaacggccctacaggtacgtttactaatcgtcttctctggctccaagtctggccaaacgccggtccctccctgaccctatcctcgtcgggcctaccgaaccgtggaacggacggacggtcctactaacttattattcgacgtacgtctacattaactaaccgaagacgtaacgccgttacgtacggtttcggggttcggtttccggggaccgggtaacggggtacccggtaaccgtcggtacccggttacgttacggtaccgaacggtccccgaaaggtcccgtaccggtccccccg

SEQ ID NO: 60648 - DNA, 581 bp, Homo sapiens
  misc_feature: GYAE6OF01CM546.37.74.G08.1.454.CMB.1.raw
  modified_base (221)..(221): a, c, t, g, unknown or other
  misc_feature (221)..(221): n is a, c, g, or t
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagtagtgtagatcacgaccggtgctcgatttagtagctctatcgaggggggggtctcaggaggcagcgctctcaggacatctccaccatggcctgggctctgctgctcctcaccctcctcactcagggcacgagggtcctgggcccagtctgccctgactcagcctgcctcgtgtctgggtctcgtggacagtcatcaccatctcctgcactggaaccngcagtgatattagtaaacttataaccttgtctcttaggtaccaacagccaccaggacaaacgccccaaactccatgatttgngagacagtaacgcgtcctgtagggtttcaagtctcttctcgtcggctcgaatcnggacacgcggcctcctagactactctacgtcggtcctacgagcgtagacggacgaggtctaaggtatttacgttacgtcgtcgtctactactattacgtcgtacgttaggtacgtcttacgttactttagtacgttcgttaacgggtagtacgggtaccgtaacggtacccgtccgttaccgtaacgtcgaaccgacccgaaccgacccaacccgtgttacccg

SEQ ID NO: 60649 - DNA, 583 bp, Homo sapiens
  misc_feature: GYAE6OF01B7KLG.37.74.G08.1.454.CMB.1.raw
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
tcagtagtgtagatcacgaccggtgctcgatttagtagctctatcgaaggggggggtctcgaggaggcagcgcctcctcaggacatctccaccagtggccgtgggctctggctgctcctcaccctcctcactcagggcacgagggtcctgggcccagtctgccctgactcagcctgccttcgtgtcgtgggtctccgtggacaggtccatccaccatctccgtgaccatgggaaccagctaaggtgagttggtagttaataaagttctgtctcgttaggtaaccaacatccaaccaacactaccaccaaggcaaactccccaaaatcataattagngacggtcaactaaccggcctagaggtatttnaactcgtntcctgtcgctacaagtcnggacaacgcgcctacgtnacctntctcgtggtcctacgaactgaggacgacgctanacttatnttagctagctatanacgtanaacgcagcgttcagggttttcggngttaccgggcggacgggtacccaacggttcctacggtccgtttacggaccgacgtcccggaaacgccgttacccgtcccccgg

SEQ ID NO: 60650 - DNA, 673 bp, Homo sapiens
  misc_feature: GYAE6OF01CZD2R.37.74.G08.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
tcagtagtgtagatcacgaccggtgctcgatttagtagctctatcgagggggggggtctcaggaggcagcgctctcaggacatctccaccatggcctgggctctgctgctcctcaccctcctcactcagggcacagggtcctgggcccagtctgccctgactcagcctgcctccgtgtcgtgggtcctccgtggacagtcgactcaccatctccngccatggaaccngcagtgacgttggtagttaataatattgtctcgttacggtaacctaactactccaacctaacactaccgaacccaaggacctaaaaccgtaccccctaaaactacctaatttaaacttttaacgacggtaaccgtaaccaacccgttaaaaccgggtccccttaaggtaacggttacgtttaactaactcgttccttacgtcgttcggtacctacgacgttacctcggaccgaaccgtacccggtcccctaccgtaccgacctacttccgtacgtcgggtaccctaccgaaccgtaggaacggacgtacggtactacgtacttattactgacacgctacataacacaacgctacgcgtcctaggttcgggtggttaccgggaccggtacggaccgtaccgcggttaccgtcgtacgtcgaccgaccgcggtccctcccggtacccg

SEQ ID NO: 60651 - DNA, 707 bp, Homo sapiens
  misc_feature: GYAE6OF01C7WVN.37.74.G08.1.454.CMB.1.raw
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacgagggtcctgggcccagtctcgccctgactcacgcctgccctccggtgtcgtgggtcctccgtggacagtcgatccaaccntcctcctgctacgtcggaaccagctagtgacggttggtgttaataaatntgtctgtagtacaacatcacacntccaccagacaacgtacccaaatctataattangacgtacaacgtaaccggcctagaagtacttactaacgtcgtacttctcgtcggaccttactaagttccgacgaacccgaacgtacccgggtccccttaccgtacgaacccttaactccgtcggttccgggtacctaacccgtaacccggtaggtaaccggaaccgggtacggtacccttaactaactttaagtttaacgttcggacctacggttacctaactacgtaaacgtaaccaacggtctaacgtaccgttacggtaacgtttcggggtaccggttacggggaccgggtaaccgggaacccgttaccggtccggtaacccggttcgttaaccgggtaccgaacccggtacccggtacggttacccgtccccggttacccccgg

SEQ ID NO: 60652 - DNA, 709 bp, Homo sapiens
  misc_feature: GYAE6OF01DD2OS.37.74.G08.1.454.CMB.1.raw
  modified_base (227)..(227): a, c, t, g, unknown or other
  misc_feature (227)..(227): n is a, c, g, or t
  modified_base (283)..(283): a, c, t, g, unknown or other
  misc_feature (283)..(283): n is a, c, g, or t
  modified_base (379)..(379): a, c, t, g, unknown or other
  misc_feature (379)..(379): n is a, c, g, or t
tcagtagtgtagatcacgaccggtgctcgatttagtagctctatcgagggggggggtctcaggaggcagcgctctcaggacatctccaccatggcctgggctctgctgctcctcaccctctcactcagggcacgagggtcctgggcccagtctcgccctgactcagcctgcctcgtgtctggtctccgtggacagtcatcaccatcctcctgctacgtacggaaccngcaggtcggtacggtttggtagttaaataaattatgttcttcgttagtaacccaanctaccaaccaactactaccaacccgaggacctaaaccgtaccccaaatacgtaattaatttagagtacgtacaaccgttaaccgcctagtaacgtntttacctaatcgtcttcgtacgtcggtcctacgtaaggtctacgggaaccctacgtacccggtacccttcccgactacctacttccgtacgtcggacccctaccgtaaccggtaggtacggaaccggtaggtaccctactaaaccgtttagttacttacggacctacgttacccaattaacgtaaccgtaaacaacggtcaaccggtacgtttaccggtaacggtttcggggtacggttacgggacccgggggtaagtaccccgggtacttacgggtcccgttagttacccggactaccggaccgtaccgttccgtccccgtacccccgg

SEQ ID NO: 60653 - DNA, 718 bp, Homo sapiens
  misc_feature: GYAE6OF01EMOCE.37.74.G08.1.454.CMB.1.raw
  modified_base (278)..(278): a, c, t, g, unknown or other
  misc_feature (278)..(278): n is a, c, g, or t
tcagtagtgtagatcacgaccggtgctcgatttagtagctctatcgagggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtctccgtggacagtcgatccaccatcctcctgcactcggaaccagcagtgtacggttggtaggttaataatgtgtctcgttacggaaccaanactaccaaccaactactaccaacccgaggaacctaaaaccgtaccccaaaacgtctaattaatttagagtacgtactaacgtaaaccggccctacgaacggttacgtttactaacgttccgtcttacgtcgttcggaccttacgtaagttccgtacggaaccaaccgtaccgtcccgttaccgtacgaccctactccgtcgtcgggaccctaaccgacgtaggacggacgcggtcctactacgttattacgtcgcacgtctacctaagtactaacgacgtactaccggtacgttacgtacggtttaggggggtccgttaacgggggaccggggaaaccgggtacccggtaacccgtttccgggtaacccggtttcgttaacccgggcccgaaaccggttaccccgggaaccgttccccggtaacccccgggttcccccgg

SEQ ID NO: 60654 - DNA, 579 bp, Homo sapiens
  misc_feature: GYAE6OF01EM7N8.37.74.G08.1.454.CMB.1.raw
  modified_base (328)..(328): a, c, t, g, unknown or other
  misc_feature (328)..(328): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataatatgtctcttggtaccaacatcaaccaacatccacccaggacaaacgtccccaaactcaataatttatgagtcactaaacgccctnaggtagtttactaatcgtcttctctcgctccaagtctggacaacgaccgcctcctacgacctactctcgtcgggcctaccaacctggacggacgacgctacacttatttagtcgctagtctactaatactaacaagcaggccgttacgacggtttggggttcggttccgggacgggacggggacccgtacgtcggtacccggttcgttacgggtccaacggacccgaacgggtccgtcccggtccccccgg

SEQ ID NO: 60655 - DNA, 681 bp, Homo sapiens
  misc_feature: GYAE6OF01DC6JD.37.74.G08.1.454.CMB.1.raw
tcagtagtgtagatcacgaccggtgctcgatttagtagctctatcgagggggggggtctcaggaggcagcgctctcaggacatctccaccatggcctgggctctgctgctcctcaccctctcactcagggcacgagggtcctgggcccagtctgccctgactcagcctgcctcgtgtcgtcgggtctccgtggacagtcgactcaccattcctccgtagctacgtacggaaacctgcgtagtgtacggttggtagttaataagtatgtcttcgttacgtaacctaatactcaaccaacactacaccgaaggacctaaccgtacccaaactctaattaacgtttatcggtaacgtacgtaaaccgtaacccgcctagacggttacttactacgtcgtacttctcgtacgtctacctaagtctacggtaccaaccgtccggtaccctaccgtacgtaacctacgttccgtacggtaccggtcccttaaccgaacggtcgggacggtacgtcggtacctacctaacgtttagtacgttgaccgtacgtcctaagtactacgtaaacgacgtcgaagtcccgtagtacgggttcgggtcggacgggtaccggaccggtaccggtacccgtcggttacgttacgttacggtacccgacgaccggacgtcccgtacgtccccccggg

SEQ ID NO: 60656 - DNA, 790 bp, Homo sapiens
  misc_feature: GYAE6OF01C81WU.37.74.G08.1.454.CMB.1.raw
  modified_base (213)..(213): a, c, t, g, unknown or other
  misc_feature (213)..(213): n is a, c, g, or t
tcagtagtgtagatcacgaccggtgctcgatttagtagctctatcgagggggggggtctcaggaggcagcgctctcaggacatctccaccatggcctgggctctgctgctcctcaccctcctcactcacgggcacgagggtcctcgggccagtctcgccctgactcagcctgcctcgtcgtcgtcggtctccgtggacacgtcgactacaccnctcctcctgaccacgtacggaaccagcgtaggttcggtacggtttagggttaaggtttaaataaaagttcgttcggttaccttacgtttaacggtaaaccaactacctaccaaacctaacgtacctaccccgaacccggtaacggaaacctaaaaccccgttaacccctaaaacctattaaactttaaggttttaacgaacggtaaccggttaacccaaaccgggttaaacccggtccgttaacgtaacgggtttaactttacgtaacgttccggttctttacggtccgtaacggtcctaacgttaacgtcgtaccggtaaccgaacccgtaccgtacccttccgtacgacccttatccgtacggtccgtacctaccgtaacggtacggacggtacgacgtacccgttattaacgttcttacgtcacgtacgtctaactacgtaactacgtacgaccgtacgtaccgttacgtgggttcggcggttacggggaccggttaccgggcccgtaacggtccgttacccggttcgtaacgtcccggaacgtaccccggacggttcccgtacccggtcccgg

SEQ ID NO: 60657 - DNA, 513 bp, Homo sapiens
  misc_feature: GYAE6OF01AE541.37.74.G08.1.454.CMB.1.raw
  modified_base (221)..(221): a, c, t, g, unknown or other
  misc_feature (221)..(221): n is a, c, g, or t
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataatatgtctcttggtaccaacatcaccaacatcacccaggacaaacgtccccaaactcaattaatttatgaggtcaactaaacggccctcaggtattactatcgtctctctgctcagtctgcacncgcctccgtgacatctcgtcgggctccgaggctggacgggacgngcgtgtattattacngctgctcatntgcgtagtacnctacttntatgtcgttcggagtcgggactacggtactaccgtaccagtacacgcccgaacggtacccc

SEQ ID NO: 60658 - DNA, 749 bp, Homo sapiens
  misc_feature: GYAE6OF01A4GMG.37.74.G08.1.454.CMB.1.raw
  modified_base (322)..(322): a, c, t, g, unknown or other
  misc_feature (322)..(322): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctctgcactggaaccagcagtgtacgttggtagttaataaatatgtctcgttaggtaccaacatcaaccaacactcaacccgaggaccaaacgtaccccaaactcaattaactttancgagtaccaacgtaaccggcctagaggtactttactaagtcgtactttctcgtcggccttaccgaagttcctcgggaccaaaccgtccggtccccttcccgtacggaacccttacgtccgttccggttacgggtccccttaacccgaaaccgttgggaaacccggacggaccggttacctacgtaactttaagtttacgtttcgacgtaacggtccttaacgtaacttaacgttaaaccgaacggtaccgtaaccggtaccgttacgttacgggttttaggggggttccggttaccgggggaaccggggtaaccggggtacccccgttaaccggttcgggtaaccccggttttacggttaacccgggtacccgaaccgggtaaccccccggtaaacgggtcccgggttcccccgttacccccccggg

SEQ ID NO: 60659 - DNA, 632 bp, Homo sapiens
  misc_feature: GYAE6OF01CKHVB.37.74.G08.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
tcagtagtgtagatcacgaccggtgctcgatttagtagctctatcgaggggggggtctcaggaggcagcgctctcaggacatctccaccatggcctgggctctgctgctcctcaccctctcactcagggcacgagggtcctgggcccagtctgccctgactcagcctgcctcgtgtctgggtctctggacagtcatcacatctcctgccacgtcggaacccnagtcgacggttggtgttanactatgtctcgttgtaccaacatccaccgaggacaacgtccccaaactcactgtatttagtgacggtacaacgtaaaccggccctacgagggtctacgtaactcgctttcgtctggctccgtaagtctcggacaaccgaccggtcctccctacgaccacttccgtcgtcgggtcctaccgacggtctcggacgacggacggtcttaccgtaacttatttacgttcgacgtacgcttacgtaattaactacgaacgcacgtacactccgttaggttcgggtggtttacgggccgggtacgggacccgtaccgggttacgtaacccggttcgttaaccggtcgaacggtacccgaacgggtcccgttacccggtcccccgtcggttacccccg

SEQ ID NO: 60660 - DNA, 710 bp, Homo sapiens
  misc_feature: GYAE6OF01BLOSA.37.74.G08.1.454.CMB.1.raw
  modified_base (221)..(221): a, c, t, g, unknown or other
  misc_feature (221)..(221): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttaataatatgtctcttggtaccaacatcaccaacactacacccaggacaaacgtaccccaaactcataatttatagagtacaacgtaaccgcctacgaggtagtttactaatcgtcttctcgtcggctaccaagttctacggacaaccgaccggtccctaccctacgaccctattccgtccgtcgggtaccctaccgtaaccgtaggacggaccggacggtcctaccgtaacgttaatttacgttcgacacgtaccgttacaacttaacgtaaccgtaaacgccggtaacggtaccgttaccgtaacgggttttcgggggttaaccgggttaccggggaccggggtaaaccgggggtacccccggtaacccggttaccgggtaaaccccggtttaccggtttaaccgggtacccgtaaccccgggtaccccggtaaaccgggttccccggtcccccgggttaccccccccggg

SEQ ID NO: 60661 - DNA, 661 bp, Homo sapiens
  misc_feature: GYAE6OF01CG0FX.37.74.G08.1.454.CMB.1.raw
  modified_base (192)..(192): a, c, t, g, unknown or other
  misc_feature (192)..(192): n is a, c, g, or t
  modified_base (224)..(224): a, c, t, g, unknown or other
  misc_feature (224)..(224): n is a, c, g, or t
  modified_base (320)..(320): a, c, t, g, unknown or other
  misc_feature (320)..(320): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacngtcgatccaccatcctcctgccactggaaccngcagtgacgttggtagttaataaatatgtctcttggaccaacactcaccaacactccaacccaggaccaaacgtccccaaacttcaattaatttangtaagtacaacgtaaaccggccctacgtaggtacgtttctaactcgtacttctctcggcctaccgtaagtcgtcggaccaaccgaccggtccctcccgtacgaaccctacttccgtccgtcgggtccccttaacccaaccggtaggacgggtaccgacggtcctacgtacttaacgtttacgttacgactacgtccttaacacgttaactacgaaacgtcaacggtccgttacgtacggttcggggtggttaccggggaccgggtacgggtacccgtaccgttcggtaacccgttcggttaaccggcacggacccgaacggtcccgtccggtccccccggg

SEQ ID NO: 60662 - DNA, 537 bp, Homo sapiens
  misc_feature: GYAE6OF01E00HK.37.74.G08.1.454.CMB.1.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
tcagtagtgtagatcacgaccggtgctcgatttagtagctctatcagggggggggtctcaggaggcagcgctctcaggacatctccaccatggcctgggctctgctgctcctcactctcctcactcaggacacagggtcctgggcccagtctgccctgactcagcctgcctccgtgtctgggtctcctggacagtcgatcaccatctcctgccactggaaccngcagtgattattagaaacttataaccttgtctcttggtaccaacagcaccaggaccaaacgccccaaatcatagatttgagaggacagtaacgcgccctcgtagggttcatcgcttctctgctcagtcngacacgcgcctcctgacatctcgtcggctccgagcgtgaggacgaggctagtatttatacgtgtctgctctagtatcgacgtaggtactactacgttctagttcgttccgttacgggtaacgtacggaacgtaacggtccaacccgttactaacgtcgacgacccgaacgtaccccaacccgtcg

SEQ ID NO: 60663 - DNA, 855 bp, Homo sapiens
  misc_feature: GYAE6OF01BG067.37.74.G08.1.454.CMB.1.raw
  modified_base (239)..(239): a, c, t, g, unknown or other
  misc_feature (239)..(239): n is a, c, g, or t
  modified_base (293)..(293): a, c, t, g, unknown or other
  misc_feature (293)..(293): n is a, c, g, or t
tcagtagtgtagatcacgaccggtgctcgatttagtagctctatcgagggggggtctcaggaggcagcgctctcaggacatctccaccatggcctgggctctgctgcctcctccaccctcctcactcagggcacgacgggtcctgggcccagtctgcccctgacctcagcctcgcccttccgtgtcttcgggtcctccgtggacagtcgatccacctatcctcctgcacgtcggaaccngcgaggtcgtacggtttgggtagttaataaatattgtcttcgttacgtaccaanctacaaccaacacgtacacccgacggacaaccgtacccaaactactaattaatttagtacgaacggtacctaaccgttaaacccggtccctaacgtacggttaacggtttaccttaaacgtccgttacctttccgttcgtaccggtaccgtaccgtaacggttccgtacggtaacccgtaaaccggacccgggtaccccttaccccggtaacgtaaccccttacgttacccggttccgtaccgggtacccctacccgtaaccgtacggtaacgggaccggacggtaacccgttacctttaacgtttactttaaccgttacgtaaccgttacggtccttaaccgtaactttaaacctaaaccggtaacgtaacccggtaccgggttacccgttaccggttaaccgggttttcgggggttaaccgggttaccgggggtaacccggggtaacccggggaacccggttacccggttacccgggtaacccggtttaaccggttaccgggtaaccggtaccccggacccggtaacccggtaccccggttcccccggttaccccccggg

SEQ ID NO: 60664 - DNA, 595 bp, Homo sapiens
  misc_feature: GYAE6OF01CWL50.37.74.G08.1.454.CMB.1.raw
  modified_base (373)..(373): a, c, t, g, unknown or other
  misc_feature (373)..(373): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatccaccatcctcctgcactcggaaccagcagtgacgttggtgttaataatatgtctcttggtacaacatcaaccaacatcaccaggcaaacgcccaaactcataattatagagtcactaacggcctcgagggtctctaagtcgtactctctgctcaagtctgacacaccggcctccncgaccgatccttcgcgggtcctccaggcctgaccgaacggaggtactaccgtaacttagttactttcgcgtaacgtctacgtaattacaacctacgtacgagtacctaattaccgtacgtttggggttacggttccgggacgggaaccgggtaacccgtacccgttacgtacccggttacgtttaacggtaccgtaacccgcccggtaaacggtacccccgg

SEQ ID NO: 60665 - DNA, 723 bp, Homo sapiens
  misc_feature: GYAE6OF01ALASQ.37.74.G08.1.454.CMB.1.raw
  modified_base (141)..(141): a, c, t, g, unknown or other
  misc_feature (141)..(141): n is a, c, g, or t
  modified_base (595)..(595): a, c, t, g, unknown or other
  misc_feature (595)..(595): n is a, c, g, or t
tcagtagtgtagatcacgaccggtgctcgatttagtagctctatcgaggggggggtctcaggaggcagcgctctcaggacatctccaccatggcctggctctgctgctcctcaccctcctcactcgaggcacgacggtccncgggcccagtctcgccctgactcacgcctcgtcctccgcgttcgtcgggtcctccgtgacagtcatcaccatctcctgcacgtggaaccagcagtgtacggttggttaaggttaataaattacgtgttccgtttacgttacggttaaccaaactactaccaaaccaaactaccgtacccaacccggtaagaacctaaaaccgttacccccaaacgttacaagtttaaatttacggtacgtaacggtacaaaacccgtaaacccggtccctagtaacggtttaagtttaacctaacgtcccgtttcttaaccgtccggtacggtacccttaacgtaaacgttccgaacgtaaccgaaacccgtcccgtacccttaccgactacgtacttccgacgtaccggaccttaccgaagtcggaagcgtacgtactacgtaaccttagttacgtcacgtanacctataacgatacgaggactcgtactacggttagttggggacgtccgggaacgggaccggtacccgtatcccggtacggttcaaaccggttccaaccggaaccgtggtccccttccggtaacccccg

SEQ ID NO: 60666 - DNA, 592 bp, Homo sapiens
  misc_feature: GYAE6OF01BFYXV.37.74.G08.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (514)..(514): a, c, t, g, unknown or other
  misc_feature (514)..(514): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacaggtcgaatccaccatctcctgcactggaaccngcagtgacgtttggngttataaatntgtctcttggaccaacatnaaccanatccacccaggcaaagtcccaaactcataactttngacgtcaactaaacggcctanaggagtttctaagtctcttacnctggctccaagtctggacaacgcggtacctccctgaccagtctcgtggctaccgaacctgaacggtacgcggactcaacgttactaagttcgacttagcgtacaataacttaccaagtacacggtcctacgaacccgtttgggtcggttcgggtaccggggngggtaaccccgacgttcggtacccggttacttttacgggacctacggacccgtaaacggcccgttaaccgccccccgg

SEQ ID NO: 60667 - DNA, 804 bp, Homo sapiens
  misc_feature: GYAE6OF01AJ2HY.37.74.G08.1.454.CMB.1.raw
  modified_base (279)..(279): a, c, t, g, unknown or other
  misc_feature (279)..(279): n is a, c, g, or t
  modified_base (685)..(685): a, c, t, g, unknown or other
  misc_feature (685)..(685): n is a, c, g, or t
  modified_base (692)..(692): a, c, t, g, unknown or other
  misc_feature (692)..(692): n is a, c, g, or t
  modified_base (706)..(706): a, c, t, g, unknown or other
  misc_feature (706)..(706): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcgagggcacgagggtcctcgggcccagtctcgccctgacctcacgcctcgcctcgtgtcgtgggtcctcgtggacaggtcgactccaacctcttcctcctgcctacgtacggaaccagcgtaggtcggtacggtttggttagttaataaagttnttcgttcttacgttaccggtaacctaacgtacctacccaaacctaactaccgttaaccccgaaccccgtaacgggtaaccctaaaaaccccgttaccccctaaaaacgttcttaaaacgttttaaacgttttaggtacgggtaaccggttaacccgtaaaaccggttaaaacccccgggttccgtttaacggtaaacgggtttaaccggtttttaaccgtaaacgtttcccgtttaaccgtttccgttaccggttacggttaacccgttaccgtaaacggttccgtacggaaacccgtaaacccgtcccggttaccccttcccgtaacgtacccttaacgttccgtaccggtcggtaccctacccgaacgtacgggacgacggtacgtctagtacctttatcgtcnctacgtnactagtactacgancgctagtccgtggttcgggtcgacggacgggtaccgtcctacggtcggttaccgttacgtacggccctacggaaccggtcctccgtcccggtaccccg

SEQ ID NO: 60668 - DNA, 638 bp, Homo sapiens
  misc_feature: GYAE6OF01EBJ2K.37.74.G08.1.454.CMB.1.raw
  modified_base (440)..(440): a, c, t, g, unknown or other
  misc_feature (440)..(440): n is a, c, g, or t
  modified_base (620)..(620): a, c, t, g, unknown or other
  misc_feature (620)..(620): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacgagggtcctgggcccagtctcgccctgactcagcctgcctcgtgtctggtctcctggacagtcgatccaccatcctcctgcactaggaaccagcaggtgtacggttggtagttaattaaatattgtcttcttacggtaaccaactataccaaccaaccataccacccgaaggaccaaaccgtaccccaaactcatagtatttagtgtaggtacaacgtaaaccggtccctcggtacggggtcttacgtaatccgtcttctcgtcgctacctaagtctaggaccaacgacccgtcctccctgaccctntcctcgtggtcctaccgaggtcgtacggacggacgacgtcctacgaactttattactgacagtacctagtaattactaacgaacgtactagcctaacgtcgtaccgggttttaggggtcggttacgggccggggtaacggacccggtaaccgtacgggtacccttacgggttacggaccnccggtaccggtaacccgg

SEQ ID NO: 60669 - DNA, 766 bp, Homo sapiens
  misc_feature: GYAE6OF01APN4P.37.74.G08.1.454.CMB.1.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
tcagtagtgtagatcacgaccggtgctcgatttagtagctctatcagggggggggtctcaggaggcagcgctctcaggacatctccaccatggcctgggctctgctgctcctcaccctctcactcagggcacgagggtcctgggcccagtctcgccctgactcagcctgcctccgtgtcgtcgggtctccgtggacagtcgatcacctatcctcctgacctacgtacggaaccngctaggtgtacggttggtagttaataatntgtctactacggtacctaacatacacctaacactccaccgaggacaaccgtacccaaactactaattaattatacgtacgtaccgaaccgtaaccggtaccctacggaaggttacctttacgttaactaccgtccttcgttcgtacggtacctaccgtaacgtacgtacggtaccgtaaccgtaccccgtacccgttacccgtacctacccgttaacgtcccgtacggttacccggtacccgtaacccgtaaccgtagggtaacgggaacccggtacggtaccttaccgttaacgttactttacggtccgtacgtacgtcctaacgttaactaactaaccggaacgtaccgtaacgtcgttaacccgttggttaccggggttacggtcccggggtaaccggggtaacccggggtacccggttaacccgttcccgggttacggttaccggttacggtacccgaaccggtcccggaacggtcccccgtccccggttacccccggg

SEQ ID NO: 60670 - DNA, 784 bp, Homo sapiens
  misc_feature: GYAE6OF01A00DZ.37.74.G08.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (624)..(624): a, c, t, g, unknown or other
  misc_feature (624)..(624): n is a, c, g, or t
tcagtagtgtagatcacgaccggtgctcgatttagtagctctatcaggggggggtctcaggaggcagcgctctcaggacatctccaccatggcctgggctctgcttctcctcaccctcctcactcgagggcacgagggtcctgggcccagtctcgccctgactcagcctgcctcgtgtctgggtcctccgtggacngtcgatccacctatcctcctgcacgtggaaccngctaggtgtacgttggtagttaataatntgtcttacgttacggtaaccaactactaccaaccaactactaccgaaccccgaacggaacctaaaaccggtacccccaaaacttctaaacgtttaaatttacgtaggtaacggtacctaaaccggtaaacccggtcccctaggtaacggttaacgtttactaaacgtccgttcctttcgtacgtcggtacctaccggtaacgttccgtaacggacccaaccgtacccggtccccgttacccctacgaaccctcgttacccgtccggtcggtacccgtacccgacgtccgtacggaaccggacgtacggtacctacgtaacttagttacgtacgacctacggtactacgttaacgtaactaaccgaanccgtaacgacctacggttaccggttacggtttacggggttaccgggttcccggggaaccggggtacccggggaccccgttaacccggttccgggttacccgtttacggttaacgggtacccgtaacccggacccggtacgggttccccgttacccccggg

SEQ ID NO: 60671 - DNA, 697 bp, Homo sapiens
  misc_feature: GYAE6OF01C5YES.37.74.G08.1.454.CMB.1.raw
  modified_base (232)..(232): a, c, t, g, unknown or other
  misc_feature (232)..(232): n is a, c, g, or t
  modified_base (563)..(563): a, c, t, g, unknown or other
  misc_feature (563)..(563): n is a, c, g, or t
tcagtagtgtagatcacgaccggtgctcgatttagtagctctatcgaggggggggtctcaggaggcagcgctctcaggacatctccaccatggcctgggctctgctgctcctcaccctcctcactcagggcacgagggtcctgggcccagtctcgccctgactcagcctgcctcgtgtcgtgggtctccgtggacaggtcatccacctatcctcctgccacgtcggaacccngtaggtcgtacggttgggtagttaataacttatgtcttcgttacggtaaccaatactaccaaccgacggtacaaaccgtacccccaaatctagttagtactttagacggtaaacggtaaaccgtaaccggtccgtacggtacgggttacctactaacgtccgtacttcctcgtacggtacctaccgtaacgttcgtacggaccgtaaacccgtccggtccccttaccgtacgacccttacgttccgtacggtcggtcctaccggacggtacgtacgaaccggacggtacgtctactacttattatcggctacgtcactaatactaacgacncgagtctacgacgttcgggttgggtacggttccgggacggacccgggtacctacggttaccggtaccggttacggtacgtccgaaaccggcccgtaacggtcccgttcccggtaccccgttgtcccgtacccgg

SEQ ID NO: 60672 - DNA, 801 bp, Homo sapiens
  misc_feature: GYAE6OF01B70K5.37.74.G08.1.454.CMB.1.raw
tcagtagtgtagatcacgaccggtgctcgatttagtagctctatcgagggggggggtctcaggaggcagcgctctcaggacatctccaccatggcctgggctctgctgctcctccaccctctcactcgagggcacgagggtccgtcgggcccaggttcctcgccctgacctcacgccctcgtcctccgtcgttcggtcggtcctccgtacgactagtcgatccactactcctcctcgctacgtacggaaccaggacgtaggttggtacggttgggttaagttaaattaagttgtcttaccgttacgttacggtaaaccaacttactaacccaaaccgaaacctaccgtacccgaaacccggtaaggaaaccctaaaaacccgttaccccaaaaccttattaaattttaacgttttaagacggtaacgtttaaacccgaaaaccggttaccgggcccgttaacggggttacggttaccctaagttaaccgttccgtttacgtttacctcgtccggacccttaaacggtaacgtccggtacgaaccgtaaccccggtcccggtaccccttaccggtactaacccgtccgttaccgggttccgtcccggggtacccttaccggaacggtccgaaccggaccgggtaacgtacccggtctttactaactttacgttacgtcgactacgtactacgttaactaactaacgcgtacacggtacttcgtaggtcggttacggtccgggtcggtacgggaccgtacgttaccgtggtaacccttgacggtcaccggtccgtcgtccccg

SEQ ID NO: 60673 - DNA, 605 bp, Homo sapiens
  misc_feature: GYAE6OF01CUIFZ.37.74.G08.1.454.CMB.1.raw
  modified_base (311)..(311): a, c, t, g, unknown or other
  misc_feature (311)..(311): n is a, c, g, or t
  modified_base (371)..(371): a, c, t, g, unknown or other
  misc_feature (371)..(371): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatcaccatctcctgcactggaaccagcagtgacgttggtgtaataatatgtctcttagtaccaacactcaccaacataccaccaggaccaaacgtacccaaactcatgtattangagtacaactaaccggcctcgacgggttctactaactcgtcttctctggcctacagtcgngacaccgacgcctcctcgacctactctcgtcggctccgagtcgtacgaaccgacggaccgctactactttattagttcgacacgtcctactaataacgtaacgacgacaacgtctacgtaccgttacggttcgggttcggttaccgggacggggtaaaccgggtaccccgtaccggtaccggttacccggttacggtttaaccgtacccggtacggtaacccccggtaaccggg

SEQ ID NO: 60674 - DNA, 704 bp, Homo sapiens
  misc_feature: GYAE6OF01BH4F7.37.74.G08.1.454.CMB.1.raw
  modified_base (234)..(234): a, c, t, g, unknown or other
  misc_feature (234)..(234): n is a, c, g, or t
  modified_base (542)..(542): a, c, t, g, unknown or other
  misc_feature (542)..(542): n is a, c, g, or t
  modified_base (583)..(583): a, c, t, g, unknown or other
  misc_feature (583)..(583): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacgagggtcctgggcccagtctgccctgactcagcctgcctccgtgtcgtgggtcctccgtggacaggtcaatcacctatcctccgtgccacgtacggaaccnggactaggtggtacggtttgggttagttaaattaaattagtcgttctacgttacgtaaccaactacttacaacaactactaccaaccgtagaaccaaaccgtccccaaactacaatttaattaacgtgacgtaccaacgtaaaccgtccctagaacgttacgtttactaattcgtcttctcgtcgccgttacgtaacgttccgtaggaaccctaaccgccggtcccgtcctagaccctacgtccttccgtcggtaccctaacgtaaccgtcgggaaggaccggtaacgtacctacgtactttaagttntttacggaactgtaccctaataattaacgtaaccgaagtanaccgttacgtcctacgggtttgggttaccggtgggggaccgtaccggggtaacccggtaccgtcggtacccggttgttaaccgggtaccacggaccgaccggtccgtcccggtacccccgg

SEQ ID NO: 60675 - DNA, 779 bp, Homo sapiens
  misc_feature: GYAE6OF01ARSQH.37.74.G08.1.454.CMB.1.raw
  modified_base (231)..(231): a, c, t, g, unknown or other
  misc_feature (231)..(231): n is a, c, g, or t
tcagtagtgtagatcacgaccggtgctcgatttagtagctctatcgagggggggggtctcaggaggcagcgctctcaggacatctccaccatggcctgggctctgctgcctcctccaccctcctcactcgagggcacgagggtcctgggcccagtctcgccctgactcacgcctgcctccgtgtcgtgggtctcgtggacagtcgatcaccatctctgcacgtacgaaccngctaggtgtacgtttggtagttaataatatgttcttcgtaggtaccaactactaccaactacactaccgacccgaggacctaaaccgtaccccaaactactaatttaacgttagtaggtaacgtacctaaaccgtaaacccggtccgtacgtacgggtttacgtttactaacgttcgttaccttccgtccgtcggtacctacccgtaaggttcccggtacggaaaccgtacccggtacccggtccccttaccgtaccgtacccgttaccttccgttccggtccggtacccgttaaacccgtaaccggttacgggaaccgggtaacccgtaaccggttccgttaaaccgttaacgttttaacgtttacgtcgtaccgacgttacctacgttaactaaccgttacgaacgtcgtacggtacgttaccggtacgggttgggttaccgggtcggggaaccggggtccggtacccggtaccgttccgggtacccggttagtacccgggtacctaccgggtaccctaaccgggtcccgtcccggttacccccgg

SEQ ID NO: 60676 - DNA, 713 bp, Homo sapiens
  misc_feature: GYAE6OF01DQYKR.37.74.G08.1.454.CMB.1.raw
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (332)..(332): a, c, t, g, unknown or other
  misc_feature (332)..(332): n is a, c, g, or t
  modified_base (466)..(466): a, c, t, g, unknown or other
  misc_feature (466)..(466): n is a, c, g, or t
tcagtagtgtagatcacgaccggtgctcgatttagtagctctatcgaggggggggtctcaggaggcagcgctctcaggacatctccaccatggcctgggctctgctgctcctcaccctcctcactcgagggcacgagggtcctgggcccagtctgccctgactcagcctgcctcgtgtcgtgggtctccgtggacagtcatccaacctntccgtcctgcacgtaggaaccngcgtagtgtacggttggtagttaataaatattgtctcgttacgtaaccacgactaccaacaacactacaccaagaccaaacgtcccaaatctaattaattnagacgtaccaacgtaaccggtcctacgtagttacgtttacaacttcgtcttctacgtggacctacagtcaggacctaaccgccgtccctcctacgaccctacgttcctacggtacgggtccctaccgtaaccgngggaaccggtacgtaacggtccttacctaacgtttatttaaccgtgtacgtacgtactaacttaacgtacgtaaaccgtacgtaccgtacgtacccgttacggtttaacgggtttccggggtaccgggtttaccggggacccgggggtaaacggtaccccggttaaccggtaccgggttaacccgttaggtttacccggaccgtacccggaccccggtaaacggtccccgtccccgggtacccccgg

SEQ ID NO: 60677 - DNA, 875 bp, Homo sapiens
  misc_feature: GYAE6OF01CNMDX.37.74.G08.1.454.CMB.1.raw
  modified_base (215)..(215): a, c, t, g, unknown or other
  misc_feature (215)..(215): n is a, c, g, or t
tcagtagtgtagatcacgaccggtgctcgatttagtagctctatcgaggggggggtctcaggaggcagcgctctcaggacatctccaccatggcctggctctgctgctcctccaccctcctcactcagggcacgacgggtcctgggcccagtctcgccctgactcagcctcgcctccgtgtcgtcgggtcctccgtggacagtcgatccaacctntcctcctcgacacgtacggaaccagctaggtcgaggtttggttagttaaattaagtagttcgttcttacgttacggtaaccaactactaccaaccaaacacaccaacccgaacgaacctaaacctacccctaaactactaatttaaagtttacgtaggtaacgtacctaaaccggtaaacccggtccgttaagaacggtttagtttaacccgtaacttccggttcctttaccgttccgtacggtaccttaccgtaacgtccgtacggaaccgaccgtaacccggtccccttacccgtacgaacccttacgtcccgttaccggtaccggtaccccgttaacccgaaccggtaacgggtaaccgggtaacccgggaccggttacctaccttaaaccggtttaatttacgggtttacgacccgttaacggtaccttaactaaactttaaccgtaaaccgtaaaaggtcccgaaacgggtttcccggttaaccggtttaacgggggtttcgggttaccggggggttaccgggggaccgggggtaaacccggggtacccggttaacccggtaccgggggttaacccggtttcgttaaaaccggggtccccgtaaaccgggtaaccccggaacggggttcccccgtaccccgggttcccccccggg

SEQ ID NO: 60678 - DNA, 823 bp, Homo sapiens
  misc_feature: GYAE6OF01C9HJP.37.74.G08.1.454.CMB.1.raw
tcagtagtgtagatcacgaccggtgctcgatttagtagctctatcgagggggggggtctcaggaggcagcgctctcaggacatctccaccatggcctgggctctgctgctcctcaccctcctcactcagggcacgagggtcctcgggcccagtctcgccctgactcagtctcgcctccgtgtcgtcgggtctccgtggacagtcgatcaccatcctcctcgacacgtacggaaccagcgtaggtggtacggtttgggtaggttaataaattagttcgttcttacgttacggtaaccaactaactaccaaccaactactaccgaacccgagaaccaaaaccgtaccccaaaacttactaacttaatttaacgtaggtaacggtaacctaaaccgtaaacccggtcctacgtaacggttacgtttactaacttcgttccttacgtccgtacggtacctccgtaaggttcctacggaaccaaccggtcccggtacccctacccgtacgaaccctacgttccggtccgtaccgggtacccctaaccgtaccggtaggacgggtaaccgacgggtacctacggtaacctttagtttacgtacggtaccgtaacgtacctaactaacgtaaccgttaaaccgaaaccggttacgaaccggttacccggttacggttaccggggtttaccggggtaccgggttaccgggggacccgggtaaccggggtaaccccgtaccgggttacccggttacccgtttaacgggttaacccgggtacccaacccgggtacccgtaaccgggttcccccgtcccgggttacccccccgg

SEQ ID NO: 60679 - DNA, 743 bp, Homo sapiens
  misc_feature: GYAE6OF01CLWT3.37.74.G08.1.454.CMB.1.raw
  modified_base (199)..(199): a, c, t, g, unknown or other
  misc_feature (199)..(199): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacgagggtcctgggcccagtctcgccctgactcacgcctcgcctccgtgtcgtgggtctccgtggacngtcgatccaccatcctcctgctacgtacggaaccagcgtagtcggtacggtttggttagttaaattaaattagttcgttaccgttcgttacggtaacccaaactaactaccaaacccaactactaccccaacccgaacggaacctaaaacccgtccccctaaaactacctaaattaacgttttaagaggtaacgtaaccaaaccgttaaacccggacccctacgtaaggttacgtttactaaacgttccgtactttctacgtcggtacctaccgtaacgttcgtacgaccaaccgccggtaccctcccgtacgacctacgtcctcggtaccggtaccctaccgaaccgtggaccggtacgacgttcctaacgtacttaacgtttactctaccgtacgtcctaacgtaagttaactaacgacgtactacggtcgttacggttcggttcgggttaggtaccggggacgggaccgggtacccgtacggttaccggtaccgttacggttacgtaccgacgtacccgtacgtcccgtcccgtaccccgg

SEQ ID NO: 60680 - DNA, 676 bp, Homo sapiens
  misc_feature: GYAE6OF01AYC39.37.74.G08.1.454.CMB.1.raw
  modified_base (167)..(167): a, c, t, g, unknown or other
  misc_feature (167)..(167): n is a, c, g, or t
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
  modified_base (534)..(534): a, c, t, g, unknown or other
  misc_feature (534)..(534): n is a, c, g, or t
  modified_base (551)..(551): a, c, t, g, unknown or other
  misc_feature (551)..(551): n is a, c, g, or t
  modified_base (563)..(563): a, c, t, g, unknown or other
  misc_feature (563)..(563): n is a, c, g, or t
tcagtagtgtagatcacgaccggtgctcgatttagtagctctatcgagggggggggtctcgaggaggcagcgctctcaggacatctccacatcggcctgggctctgctgctcctcaccctctcactcgagggcacgagggtcctgggcccagtctcgccctgactcncgtctcgcctcgtgtcgtggtctccgtggacacgtcactcacctatcctcgtcgcacgtacggaaccnggactaggttggtacgttggttaagttaataaagttntcggttcttcgttacggtaacaacactaccaacaacnctaccaccgtagacctaaaccgacccaaactagtaattaagttacgtcggtaagtaccaaaccggtaccgtccgtagtacgttacgttaactacgttcctnttccgtcgtacgtctacgacgttccgacggaacctacgccgtcccgtaccgactaccnctccgtcgtacgtcctacgaccgtacggacggtaacgcgtactcgttaacttagttcgtccatctnttataactacggtaacncgtcggtaaccncgttacgttgggttcgttacggggtacccggacgggtcgacccggtccgttacggtacgttcccggaaagtcccgaaccggtaccggtacccgtccgtccccggtaaccccgg

SEQ ID NO: 60681 - DNA, 690 bp, Homo sapiens
  misc_feature: GYAE6OF01C2TR5.37.74.G08.1.454.CMB.1.raw
  modified_base (214)..(214): a, c, t, g, unknown or other
  misc_feature (214)..(214): n is a, c, g, or t
  modified_base (494)..(494): a, c, t, g, unknown or other
  misc_feature (494)..(494): n is a, c, g, or t
  modified_base (579)..(579): a, c, t, g, unknown or other
  misc_feature (579)..(579): n is a, c, g, or t
tcagtagtgtagatcacgaccggtgctcgatttagtagctctatcgagggggggggtctcaggaggcagcgctctcaggacatctccaccatggcctgggctctgctgctcctccaccctcctcactcgagggcacgacgggtcctcgggccctagtctcgccctgactcgacgcctcgcctcgtgtcgtcggtctcgtgacagtcactcactntctcctgccacgtacgaaccagcgtaggtcgtaggttggtagttaaataaatgtcgttacttcgttacggaacctaactactaaccaacctaactaccgtaccgaacccgaacggtaacctaaaaccctacccctaaaactacttaaatttaactttagtaacggtaccgtaaccaaaccgtaaacccggtccgtacggtaaggttactttacgtaacgtccgttcttctcgtcgtacctacgtacgtcgtaccgaccgtaaccgccgtaccctccgacncctatccgtacggtccggactaccgtaacggcgaacggtcgacgtctaactacttatcgtcgacagtcctaatactaacacgacncgtacgtacgtagttcgggttagggtccggtacgggacggtaccggtaccgtaccgtcggttacccgttagtaccgccgacccgtaccgtacggcccgtcccggtacccgg

SEQ ID NO: 60682 - DNA, 707 bp, Homo sapiens
  misc_feature: GYAE6OF01CEK1O.37.74.G08.1.454.CMB.1.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
tcagtagtgtagatcacgaccggtgctcgatttagtagctctatcgaggggggggtctcgaggaggcagcgctctcaggacatctccaccatggcctgggctctgctgctcctcaccctcctcacgtcgagggcacgagggtcctgggccctagtcctcgccctgactcagcctgcctccgtgtcgtcgggtctccgtggacagtcgatcacntctcctgcacgtcggaaccgntaggtgtacggttggtagttaactaactgtcgttcttcgttacggtaaccaactactaccgaacccgaaggtaccaaaccgtaccccaaaactcgtaatagtactttagacgtaacggttaccaaaccgtaaccggtccctacggacgggttactacgtaacgtccgttaccttcgtacgtcggtacctaccgtaagtccgtacggaacctaaaccgtcccggtcccttaccgtacgaacccgttactccgtacggtcggtccttacccggagtaccgtacggaaccggacggtacgtctaactacttagttacgtcgactacgtactactaagttaactaaccgacgactacgtactacgttacggtacggttcgggttacggtccgggaccgggtacgacccgtcgtacggtcccgttacggtacgtccggtaccgacccgtacggtcccctccggtccccgtgttacccg

SEQ ID NO: 60683 - DNA, 653 bp, Homo sapiens
  misc_feature: GYAE6OF01BRP2U.37.74.G08.1.454.CMB.1.raw
tcagtagtgtagatcacgaccggtgctcgatttagtagctctatcgaggggggggtctcaggaggcagcgctctcaggacatctccaccatggcctgggctctgctgctcctcaccctcctcactcagggcacagggtcctgggcccagtctgccctgactcagcctgcctcgtgtctggtctcgtggacagtcgatcacatctcctgcactggaaccagcagtgacgttggtagttaataatatgtctcttaggtaccaacatcaccaacatacacccaggaccaacgtaccccaaagtcctaataatttatagtaggtaccaacgtaaacggccctacgaggtagtttactaagttcgcttctctggtcctacgagtctgactacaccggcctcccgtacgacctacgttcctcgtcgggtccctaccgaaccgtaggacggaccggtacggacttaccgtaaccttatttacgtttacgccgtagtcctactaacgttactaacctaacggactacggtacgttactacggtttgggtccgggtttaccggggacggggtaacggggtaaccccggaccggttcggaacccggtttcggtttaacgggtacacccgggaccctaacgggcccgttccggtacccccccgg

SEQ ID NO: 60684 - DNA, 765 bp, Homo sapiens
  misc_feature: GYAE6OF01BK7JJ.37.74.G08.1.454.CMB.1.raw
tcagtagtgtagatcacgaccggtgctcgatttagtagctctatcgagggggggggtctcaggaggcagcgctctcaggacatctccaccatggcctgggctctgctgctcctcaccctcctcactcagggcacgagggtcctgggcccagtctcgccctgactcagcctcgcctcggtgtcgtgggtctccgtggacagtcgactccaccattctcctagctacgtacggaaccagacaggtacggtacggtttaggtaggttaaataaatacgttgtccttcgttacggaacccaacactaccaaaccaacgtactaccaacccgtaaggaacctaaaaccgtaccctaaactactaaattaactttagagaacgtacctaacgtaaaccgccctaagtacgtacgtttacaacgtcgtctttcgcgtacgtacctacgaacttcggtacggaaccaaacccgtaccgtcccgttaaccctacgtaaccctacgttaccgttaccggtacggggtacccctaacccgtaaacgttacgggaacggaaccggtagtaacccgttaccttaacttaagtttacgtacgtaccgtaacgtacctaactaacgtaagtaaccagtacctaggtaccgttaccgtagggttggttaccggggtaccggggtacggtaacccggggtaccctaccggttccggtaaccgtttacggtaacggtaccgtaaccggaacccggtaacggtccccgtacccggtacccccgg

SEQ ID NO: 60685 - DNA, 800 bp, Homo sapiens
  misc_feature: GYAE6OF01CWV7O.37.74.G08.1.454.CMB.1.raw
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctcgcctccgtgtctgggtctccgtggacagtcgatcaccatcctcctgcactggaaccagcagtgacgttggtgtaataatatgtctcttacggtaaccaacactaccaaccaacactccaaccacggaccaaacgtaccccaaatacaattaaatttatgaagtacaacgtaaccggccctagagtacttctaatcgtcttcctcgtacggtacctacgtaacgtcgtacggaccaaaccgtacccggtaccccttaccccgtaccgtaacctaccgttaccttccggtaccgggtaccccttaaccccgaaaccggttacgggaaccggggtaaccggtaacgggtacccgttaccgttaacctttaacgttttacgttaccggtaccgttaacgtaccgtttaaccgtaacgttaaaccttaaaccgaacgtaaccggtaacgttacccggttaccgttaaccgggtttacggggtttaccggggttaccgggggtaaccgggggtaaccgggggtaacccccgttacccgggttaaccggttaacccccggtttaacggtttaccggggtaacccgtaacccggacccccgggtaaacgggtccccgttacccccgggttacccccccggg

SEQ ID NO: 60686 - DNA, 729 bp, Homo sapiens
  misc_feature: GYAE6OF01B926S.37.74.G08.1.454.CMB.1.raw
tcagtagtgtagatcacgaccggtgctcgatttagtagctctatcgagggggggggtctcaggaggcagcgctctcaggacatctccaccatggcctgggctctgctgctcctcaccctcctcactcgagggcacgagggtcctgggcccagtctcgccctgactcacgcctgcctcgtgtcgtgggtctctggacagtcgatccacatctcctgacacgtacggaaccagcaggtgtacggtttggtagttaataaatagtgtctcgttacggtaaccaacactaccaaccaactactaccgaccgacgaccaaaccgtaccccaaactactaattaatttagaggtacgtacaaccgtaaaccggtccctacgtaggtacgtttactaacgtcgtccttcgtcgtcggtacctaccgtaagttccgaggtaccgaacccgtacccggtcccctacccgtacgtaaccctaccgtccgttcggtaccgggtacccctaacccgtaacgtcgggacggaaccgtaccggtacctacgtactttaagtttacgtacgacgtacgtctaactactaacgtaacgaacgtccgtacgtaccgtacgttacgggttcgggttacgggttccggggacggggtaacccgggtacccgtaacccggttcggtaccgttcggttaacgggtaccgacccggtaacccggtaccgtccccgtccccggttcccccgg

SEQ ID NO: 60687 - DNA, 773 bp, Homo sapiens
  misc_feature: GYAE6OF01CGG5P.37.74.G08.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
tcagtagtgtagatcacgaccggtgctcgatttagtagctctatcagggggggggtctcaggaggcagcgctctcaggacatctccaccatggcctgggctctgctgctcctcaccctctcactcagggcacgacgggtcctgggcccagtctcgccctgactcagcctgcctcgtgtcgtggtctccgtggacagtcatcctacctatcctccgtgaccgtacgtcgggaaaccnggtactaggtntaacgttagtttaaacgtaaaacctttaacgtttaacccgtttcgttcctttacgttaacggtaacccaacgtaacgacccgtaacccggaacggaacctaaaaccccggaacccccctaaactacgtaacgttagtttacgtttacggtacggaacggtaacggtaacggttaaccggcccggttaccgtacggttaacgggtttactacgtccgttcttccgtacgtcgtccgtaactacgttccgtacggacctacccgaccgtacccctccgaccgactacgttccgtcgtacggcctcggacggtacccgaaggtccgaaacgccggtacctacgttaacgtttacttacggtcgtacctgttaactacgtaactaaacgcgtaacgaacgttcaacggttacgtacggttacgggtcggttaggtacccggggtagggtacccggtaacgttcccgtacggtttacccgttcgtacggttaccgaccggtaccgacggtcccgtacccgtcccggtaccg

SEQ ID NO: 60688 - DNA, 757 bp, Homo sapiens
  misc_feature: GYAE6OF01EV0AD.37.74.G08.1.454.CMB.1.raw
  modified_base (208)..(208): a, c, t, g, unknown or other
  misc_feature (208)..(208): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacgagggtcctgggcccagtctgccctgactcagcctgcctcgtgtctggtctcgtggacagtcgatcacatctcctncactggaaccagcagtgacgttggtagttaataatatgtctcttacggtaccaactataccaaccaactactaccaacccaggaccaaaccgtaccccaaaactctaattaactttagtagtacggtacaaaccgtaaaccggtccctacgtaacggttacgttttactaactcggtactttcgttcgtacggtaccttaccgtaagttccgtacggaccaaacccgtaccggtcccttacccgtacgtaaccctactccgttccgtacgggtacccttaacccgaaccgttggacggacgtacggtaccttactaaacttatttaacgtttcgactacggtaccttacgtaacttaacttaaccgaaagtaccgtaacgtaccggtttacgtacgggttttcgggggttacggttacccgggggaccggggtaaccggggtaaccccggtaacccgggttcgggttaaaccccggttccggtttaaacgggtaccctaacccgggtaaccccggtaacgggttcccgttcccccgggtaaccccccgg

SEQ ID NO: 60689 - DNA, 760 bp, Homo sapiens
  misc_feature: GYAE6OF01CVIX7.37.74.G08.1.454.CMB.1.raw
  modified_base (607)..(607): a, c, t, g, unknown or other
  misc_feature (607)..(607): n is a, c, g, or t
  modified_base (649)..(649): a, c, t, g, unknown or other
  misc_feature (649)..(649): n is a, c, g, or t
  modified_base (726)..(726): a, c, t, g, unknown or other
  misc_feature (726)..(726): n is a, c, g, or t
  modified_base (742)..(742): a, c, t, g, unknown or other
  misc_feature (742)..(742): n is a, c, g, or t
tcagtagtgtagatcacgaccggtgctcgatttagtagctctatcgagggggggggtctcaggaggcagcgctctcaggacatcctcccaccatggcctgggctctgctgcctcctccaccctcctcactcgagggcacgacggtccgtcgggccagtctcgccctgacctcacgcctcgtccctcgtgtcgtcggtctcgtaggacagtcgactaccaacctctccttccgtcgcctaacgtacggaaccagtccgaggttagggtacggtttagggttaagttaaataaagttgttcgttaccgttcgttaaccgtaaacaccttaacaccaaacctaacctacctaaccccgaaccgtaaccggaaccctaaaacccgtaacccctaaaacgttactaaattttaaagtttacgtaggtaaccggttaaaccaaaccgtaaaccggtacccgtagtaacgggttacctttaacacgttcgtacccttacgtcgtaccgtacttacgaacggttacgacggaaaccaaccgggtccccgtccggtaaccacccgtactatacccgttcggtacctaccccgtaactaccggagggtacggaccgngttaccctcgtaactttagtacgctacgacttacaaccgtanaacgtccgaagaccgtcggtaacctggtcgggttggggtaactccggggacggtccggtaccgtacgtcgtacggtnttacggcgaccggtanacggtcccgcccgttccg

SEQ ID NO: 60690 - DNA, 777 bp, Homo sapiens
  misc_feature: GYAE6OF01C53XI.37.74.G08.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
tcagtagtgtagatcacgaccggtgctcgatttagtagctctatcgagggggggggtctcaggaggcagcgctctcaggacatctccaccatggcctgggctctgctgcctcctcaccctcctcactcagggcacgagggtcctgggcccagtctcgccctgactcagcctgcctcgtgtcgtgggtcctccgtggactagtcatccacctntcctcctgacacgtggaaccngcagtgtacgttggtagtaataaatgtntctcgtacgtaaccaacataccaacctaacactaccaaccgaacggaacctaaaaccgtacccctaaaactactaaactttaaatttagtacgaacggttaaccaaaccgtaaacccggtcccctaacggtaggttaactttactaacgtcttacttccttacgtcgtaccgtaaccgtaacgtcgtacggacccgtaaaccgtacccggccccttacccgacgtaacccgtacgtttccgtaccggttaccgggacccttacccggaaaccgtacgggaccggacgtacggtacccttaaccgtaagtttaactttacttacggactacgtccttaacgtaacttacgtaaacacgccttaacggtccgttacgtcgggtttcgggtacgggtacccggggacggggtaaccgggtaaccccggtccgttaccggttaaccccggggtttaagttaccgggacccgaacccgggtacccggttaaccgggccccgttcccccggtaccccccggg

SEQ ID NO: 60691 - DNA, 838 bp, Homo sapiens
  misc_feature: GYAE6OF01BFIUJ.37.74.G08.1.454.CMB.1.raw
tcagtagtgtagatcacgaccggtgctcgatttagtagctctatcgaggggggggtctcaggaggcagcgctctcaggacatctccaccatggcctggctctgctgctcctcaccctcctcactcgacgggcacgagggtcctgggcccagtctgccctgactcagcctgcctccgtgtcgtgggtcctccgtggactagtcgactcgacctatcctcctagcaccgtagggaaccagtccgaaggttggtacggtttgggtaggttaataaatatcgtacttacgttacggtaacccaactactaccgaacctaacgacgacctaacccgaaggacccgtaaaaccgacccccctaaaacgtcctaacgttcgttaacgtttttacggtaaggaacgggtaactaacggttaacggcccgggtaccccttacggttaacggggttttacctaaacgttccgtcctttccgtaccgttcggtacctacccgtaacggttcccgtacggtaacccgtaaaccgtacccgggtacccctttacccgtacgtaaacgtaaccttccggtttaccgttcgggtacccttaccggtacgggtaccgttacggggaaccggtaccggtaacggttcgtaaggttaacgttttaacttacgtcgtacgtcggtacctaacgtacgtttagacgtaacggtaacgttacgtaacgttacgtttctttaacggttccgttaaccggttaacgggtaacccggttaccgggtaaccgttaaaccggtacccgttaacccggttaacccgttaaccggtacccgaaccggtaacccccggtaaacccgg

SEQ ID NO: 60692 - DNA, 798 bp, Homo sapiens
  misc_feature: GYAE6OF01DG9LT.37.74.G08.1.454.CMB.1.raw
  modified_base (243)..(243): a, c, t, g, unknown or other
  misc_feature (243)..(243): n is a, c, g, or t
tcagtagtgtagatcacgaccggtgctcgatttagtagctctatcgaggggggggtctcaggaggcagcgctctcgaggacagtctaccaccagtcggcctgggctctgctgctcctcaccctctcactcagggcacaggtcctgggcccagtcctcgccctgacctcacgccctcgccctcgtgtacgtgggtcctcctggacagtcgactccaccatcctaccgtgccaacgtcggaaccnggactaggtgtacggttggtacgttaataaatgtgtctgttacgacctacactcaaccaacgtctaccgaccgtaagaacctaaaccgtacccctaaatacgttaaattaatttacgtacggtaacgtacctaaaaccgtaaacccggtcccctaggtaacggtacgttttacgtaacgtccgttaccgttaccgtaccgttacgggtaccctaaccggtaaacgttccggttaacgaaccgtaaccgtaccggtcccttacccgtacgtaacccacgtttacctccgggtaccggtaccgttacctaaacccgggtaggacgggaaccgtacggtaaccctcgtaaacgtacgttttatacgtacgtacgtaaccgtcaaacgttaaccgtacagtaccggtaacgtcggtttacccgaaggtttccgggttcgggtacgggaccccgggacgggttaaacccggccgttaaccggtaacccggggttacgtttaacccgggacccggttaaacccgacccgggttaaacgccccggttcccggtaaacccccg

SEQ ID NO: 60693 - DNA, 718 bp, Homo sapiens
  misc_feature: GYAE6OF01AP1OY.37.74.G08.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacgagggtcctgggcccagtctgccctgactcagcctgcctcgtgtcgtgggtctcgtggacngtcgatcaccntctcngcactcggacccnagtgacgtttggtagttataactatgtcttgttcggtaccaacatcacccaggacaaacgtaccccaaactcatatacgtttagtggtacgtacaacgtaaaccggccctacgaggggtaccttacttaacgtccgtcttaccgtcgtacggtcctacctaggttacgttcggaccgtaacccgacccgggtccccttaccccgtacccggtaaccttaccgtcccgtttcggttccggggtcccttaccgaacgggtcccgttacgggaaccggaacccggtaaccgggtccttaccgtaactttagtttacgttagacctacggtcctactagttaacttaacgacgtcaacgtctaacttaccgtacggtttcgggttaccggttcgggacgggtaccggtaacccggtaccgttaccgggtaccggttcggttaccggtccgaaccggtacccgtacggtaccccgtcccgtccccggttcggttaccccg

SEQ ID NO: 60694 - DNA, 785 bp, Homo sapiens
  misc_feature: GYAE6OF01AILLU.37.74.G08.1.454.CMB.1.raw
  modified_base (258)..(258): a, c, t, g, unknown or other
  misc_feature (258)..(258): n is a, c, g, or t
tcagtagtgtagatcacgaccggtgctcgatttagtagctctatcagggggggggtctcaggaggcagcgctctcaggacatctccaccatggcctgggctctgctgctcctcaccctctcactcgagggcacgagggtcctgggcccagtctgccctgactcagcctgcctccgtgtctgggtctcgtggacagtcgatccaccatcctcctgccagtcggaaccagcaggtcgtacggttggtagttaataaattntcgttcttacgttacgtaacctaactactaccaaccaacactaccaacccgtaggacctaaaaccgtaccccaaaacttacctaagtttaattagtacgtacgttaaccaaaccgttaaacccggcccgtacggtaacggttacgttttaacgtaaaccttccggttactttacgtaccgtcgggtaccttaccggtaacgtccgttaccggaaccgtaacccgaccccggtacccttacccctacgtacctcgttcgtaccggtccggtacccctactaacccggtaggaccggaaccgtcggtacctaccgttaactttacgtttacgtccggaccttacgtacccttaagtacctaacgtaaccgaacggtccgaacccgttcggtttaaccggtaccggtttgggggtccccggttagggggacccgggtaaccgggtccccggttaacccgtaccgggtacccgttacggttacccggtaccgaaccggtaccccggacggtccccgtaaccggtcccccgg

SEQ ID NO: 60695 - DNA, 665 bp, Homo sapiens
  misc_feature: GYAE6OF01BE19Q.37.74.G08.1.454.CMB.1.raw
  modified_base (432)..(432): a, c, t, g, unknown or other
  misc_feature (432)..(432): n is a, c, g, or t
  modified_base (473)..(473): a, c, t, g, unknown or other
  misc_feature (473)..(473): n is a, c, g, or t
  modified_base (509)..(509): a, c, t, g, unknown or other
  misc_feature (509)..(509): n is a, c, g, or t
tcagtagtgtagatcacgaccggtgctcgatttagtagctctatcgagggggggggtctcaggaggcagcgctctcaggacatctccaccatcggcctgggctctgctgcctcctccaccctcctcactcgagggcacgacgggtcctcgggccctagtctcgcccgtgactcacgcctgcctcgtgtcgtcgggtcctccgtggactaggtcgactccacctattccgtccctacgaccacgtacggaaccagctaggtcggtacggtttggtaacgtttaataaagttgttgttcttacgttaccggtaaccctaactactaccaaaccactactacccgaccgtaacgaccaaccgtacccaactctaagttaatacgtagacgtacacgtaaccgctagtacgtacttactactcgtcttcgtcgtcnctacgacgtcgtaagccgtaacccgtcgtaccttccgtacnccgtactcgtcgtcccgtactaccgactagggacgngtaccgtctacgtacttatcgtgacgtactacgttacaattaccgtaaccgaattcccgaagttccgtactcgttaggttcggggttacgtaccggggtacggtacccgggtaccacgtcgttaccgcggtcgtaccgaagcgtccgccgtccccg

SEQ ID NO: 60696 - DNA, 592 bp, Homo sapiens
  misc_feature: GYAE6OF01B8OTB.37.74.G08.1.454.CMB.1.raw
  modified_base (194)..(194): a, c, t, g, unknown or other
  misc_feature (194)..(194): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
tcagtagtgtagatcacgaccggtgctcgatttagtagctctatcagggggggggtctcaggaggcagcgctctcaggacatctccaccatggcctgggctctgctgctcctcaccctctcactcagggcacgagggtcctgggccagtctcgccctgactcacgcctgccctcgtgtcgtgggtctcgtgacngtcatcaccagtcctctgcatacggaacagcagtgtacggtgtagttataatntcgtctctacgacatanactaacactctccaccgaggaccaaacgtacccaatactaataatttnaggacgtacaacgtaaccgcctagagttattactaactcgtcttcgctcggtctacgacgtnacggacacgacgtccctaccgcgacntcgtcgcggtacctacgacctggaacggacgacgtcctacgtacttattacgtcgacgtacgtctacaacgtactacgacgactacgtccgtagtaccgggttggtaccgggttcgggacggtaccggtaacgtccgttccggtaacggttccgtacgggtccacgaccgtaaccgcccgtgtaccccccgg

SEQ ID NO: 60697 - DNA, 748 bp, Homo sapiens
  misc_feature: GYAE6OF01AIYFB.37.74.G08.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacngtcgatcaccatctcctgcactggaaccngcagtgtacggttggtagttataaatatgtctcttgtaccacatacaccacataccacccgaggactaaaccgtccccaaactctaattaatttagtaggtacgtaccaacgtaaaccggtcccctacgaacggtacgtttacctaagtcgttaccttcgtaccgtcggtcctaccgtaagtcctacggaccaaccgtacccggtcccttacccgtacgacctacgttccgtcggtaccgggtaccctacccgtaaccgttacgggaacgggtacccgtaacggtaccttaccgtaacgtttaactttacgttcgaccgttaacggtccgtttaaccgtaattaaccgtaaacctaacggtaccgtacggttaccgtaccggttaacggttttgggggttaccgggttccggggaacgggggtacccgggttaccccggtaccggttccgggtaacccggtttcggttaaccgggtaccgaacccggtaccccggaacggtccccgttccccggtcccccccggg

SEQ ID NO: 60698 - DNA, 909 bp, Homo sapiens
  misc_feature: GYAE6OF01D9M06.37.74.G08.1.454.CMB.1.raw
  modified_base (218)..(218): a, c, t, g, unknown or other
  misc_feature (218)..(218): n is a, c, g, or t
tcagtagtgtagatcacgaccggtgctcgatttagtagctctatcgaggggggggtctcaggaggcagcgctctcaggacatctccaccatggcctggctctgctgctcctcaccctcctcactcgagggcacgagggtccgtgggcccagtctgccctgactcacgcctgcctcgtgtcgtggtctccgtggacagtcgatccaccatcctccgtcncacgtacggaaccagaccaggtgttacggttggttagttaaattaatgtacgttcgttacgttacggtaaccaactactaccaaaccctaacgtaacctaccaacccgaaggtaacctaaaaccggttaaccccctaaaactcgtaacgttagttaacgttttaagtacggtaacgttaccgtaaaccggttaaacccggacccggttacggtaccggggtttactaaccgtttaaacgtcccggtttaccttaccggtaccgtttaccgggtacctttaacccggtaaaccgttacccgtaacggtaacccgtaaacccgggtaacccgttcccccgttacccggtaacccgtaacccgttcctttaccgggttacgggtttaccccgggtccgtaccggtaaccgggtaccgtacccggggaaccggtaacgggttaccgtaacccgttaaccgtttaaagtttaccgttttaacggtcgtaacgtacccgtaactttaccgtaaaacgttaaccgttaaaccggaacgtaccgtaaacggttccctaacggttaccgttacgggttttacggggttaacccgggtttaccgggggaaccggtacccggggttaaacccgtaccgggtaccggtttaaaccccggttaggttaacccggtaccgtaaccccgggtacggtaaccccggg

SEQ ID NO: 60699 - DNA, 927 bp, Homo sapiens
  misc_feature: GYAE6OF01C7XOB.37.74.G08.1.454.CMB.1.raw
  modified_base (269)..(269): a, c, t, g, unknown or other
  misc_feature (269)..(269): n is a, c, g, or t
tcagtagtgtagatcacgaccggtgctcgatttagtagctctatcgagggggggggtctcaggaggcagcgctctcaggacatctccaccatggcctgggctctgctgctcctcaccctcctcactcagggcacgagggtcctgggcccagtctcgccctgactcagcctgcctcgtgtcgtgggtctccgtggacacgtcgatccaacctactctcctgacctactcggaaaccagcgtagtgtacggttggttaggtaacttaaatntagtcttcgttacggtaaccaacactacaacctaacactaccaccgacggaacctaaaccgtacccctaaactacgtaacttttaaacttttaagtacggtaacggtaccctaaaccgttaaacccggtacccctacgtacggtttaacgttttaccgtaaactttcccggttaccttcctttccgtacggtacccgtaaccgttaacgggtaccgttaccgggtaaccgtaaacccggtacccccgttaccccggtaccccttaaccggtaacccttcgtttaacccgtccggttacccggggtaccctaacccgtaaccggtaaccgggtaacggggtacccgtaaccgggttacccttaacccgtaacgttttacgttttaaacggtcggtaacccttacggtaacccttaacgttaacgtaaacgttaacccgaaacgtaccggtaaaccggttccgggttaacgttccgggggttttacggggttaccggggttcccggggaacccgggggggttaaaccgggaacccccggttttacccggggaacccgggtttacccgggtttaacccgggtttaaccggggtacccgttaaacccccgggacccgggtttaaaccgggtccccggtttcccccccccggtaaccccgggg

SEQ ID NO: 60700 - DNA, 1015 bp, Homo sapiens
  misc_feature: GYAE6OF01CT4LM.37.74.G08.1.454.CMB.1.raw
  modified_base (256)..(256): a, c, t, g, unknown or other
  misc_feature (256)..(256): n is a, c, g, or t
tcagtagtgtagatcacgaccggtgctcgatttagtagctctatcgagggggggggtctcaggaggcagcgctctcaggacatctccaccatggcctgggctctgctgctcctcaccctcctcactcagggccacgacgggtccgtcgggcccagtcgtcgccccgtgacctcacggccctcgtcccgtccggttcgttcggtcggggttcctccgtacggtacgtacggtccgactaccaacctcttccgttccncgacccgtaaccggttaccggaaaaccgacggaccgttaacgggttgggttaaccggggtttttaggggtttaaaggtttaaattaaaaccgttgttccgtttacgtttaccggttaacggtaaacccaaaactccttaaaaccccaacctaaaaccgttccctaaaccccgtaaaccccggaacggggtaaaccccctaaaaacccgtttaccccccaaaaacgttacctttaaaattttttaaagttacgggtaaaccgggtaccgggttaaaaacccaaaacccccggttaaccgggtaccccctaaggggttttaaacggttaacccggttttaacctttaaccgtacccggtttccttttaaccccgtccggtttaaccggggtacccctttaaacccggtaagggttcccccgttaaaggggtaaacccccaaacccgggtttacccccgtccccttaacccgtaaccggtaccctaacgttccgttaccgggttaccgggaccctttaccggaaacccgggttagggaacccggttaacgggaccctacgttaaccgttacgtttaaccgtttagttaccggacgtaccgtacttaacctaagttaaccgaaaggtacccgtacttaacgggtccttacggggttacggttcggggtaccgggtaccggaacgggtaacccggtaccggtaccggtcggttaaccgtcggtaaccgtcgtaaccgggacgccggttccccgtacggtccccg

SEQ ID NO: 60701 - DNA, 743 bp, Homo sapiens
  misc_feature: GYAE6OF01BSN4E.37.74.G08.1.454.CMB.1.raw
tcagtagtgtagatcacgaccggtgctcgatttagtagctctatcgaggggggggtctcaggaggcagcgctctcaggacatctccaccatggcctgggctctgctgctcctcaccctcctcactcagggcacgagggtcctgggcccagtctcgccctgactcacgtcctgccttccgtgtcgtgggtcctccgtggactagtcgatccactatcctacctgactacgtacggaaccagctaaggttcggtacggtttggttagttaataaattagtcgtcttcgttacggtaaccaatactaccaacctaacgacttccccgaaaccgtacggaacctaaacccggtaccccaaaactacttaacttaattttacgaggtacgtttacccaaaccggtaaaacccggtccttaacggtaacggttacgtttacctaagttcctactttacctcgtcgacctaccagttccgtacgactaccgaccggtccctacctacgacctactccggttcgtccgggtacctacccgacggttaggacgggacgtaccggtctaaccgtacttaggtttactcggactaccggtctacgtaataaccgttaacgaacgtacacggaccttaaccgtcggttaacggttccggggttcggtaccgggaccgggttacccggacgtacccggttcgtaaccccggttgttaaccggaccctaacccgtccggtacgtacccgtcccccgg

SEQ ID NO: 60702 - DNA, 709 bp, Homo sapiens
  misc_feature: GYAE6OF01BL0M1.37.74.G08.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
tcagtagtgtagatcacgaccggtgctcgatttagtagctctatcagggggggggtctcaggaggcagcgctctcaggacatctccaccatggcctgggctctgctgcctcctcaccctctcactcagggcacagggtcctgggcccagtctcgccctgactcagcctgcctcgtgtctcgggtctccgtggacngtcgatcaccatctcctgcactaggaaccngcagtgacgttggtagttaataatatgtcttcgttagaaccaacactaccaaccaacactccaacccgaggacctaaacgtacccctaaactctaattaatttatcgaagtacaacgtaaccggccctagtaggtacgtttaccaattccgtctttcgtcgtacggtacccttaccgaaggttccgtaggtacccgaaacccggtacccggtaccccttacccgtacggtaacccctacttcccgttaccggttcccggggtccttaaacccccggtaaccggtacgggtaaccgggaccgtacgggtaccttaccctaaactttagtttaactacggtacagttaccgtactaacgtaactaacgacgacctacgtccgtaccttagggttcgggttcggtacgggacggaccgggtaccgtaccggttccgtaccggttagtaccggtacgaccgtaccgaacggtccgtcccggtcccccg

SEQ ID NO: 60703 - DNA, 671 bp, Homo sapiens
  misc_feature: GYAE6OF01C5HCP.37.74.G08.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (331)..(331): a, c, t, g, unknown or other
  misc_feature (331)..(331): n is a, c, g, or t
  modified_base (376)..(376): a, c, t, g, unknown or other
  misc_feature (376)..(376): n is a, c, g, or t
  modified_base (553)..(553): a, c, t, g, unknown or other
  misc_feature (553)..(553): n is a, c, g, or t
tcagtagtgtagatcacgaccggtgctcgatttagtagctctatcgaggggggggtctcaggaggcagcgctctcaggacatctccaccatggcctgggctctgctgctcctcaccctctcactcagggcacgagggtcctgggcccagtctgaccctgactcgagcctgccctcgtgtcgtgggtctaccgnggaacnggtcatccacctatctccgtgccacgtggaaccccgntaggtcggtacggtttggtagttaactaacgtagtcgtcttacgttacggtaccaactctaccacccaggaccaacgtacccaatcatgtattangacgtacaacgtaaccgcctagtacgggtctacgtactcgtcttntcgtacgctaccgtagtaccgtaggaccaaccgtccgtaccccgtcctacggtaacctagttacccgtccgttcggggacccttacggacgtaccgtacggaaccgtacgggacgtaccttacgacctttaagttagtcgtacgactaccttagaactaataaccgaagtcgtaacncgtaattcccggtaggtttacgggtacgtaccgggacgggtaccgaccgacccggttagtaccggttaccgtacgaccgtaacggccgtaaccgtccgcccggtaccccgtgtacccg

SEQ ID NO: 60704 - DNA, 734 bp, Homo sapiens
  misc_feature: GYAE6OF01BYQM9.37.74.G08.1.454.CMB.1.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (280)..(280): a, c, t, g, unknown or other
  misc_feature (280)..(280): n is a, c, g, or t
  modified_base (453)..(453): a, c, t, g, unknown or other
  misc_feature (453)..(453): n is a, c, g, or t
tcagtagtgtagatcacgaccggtgctcgatttagtagctctatcgagggggggggtctcaggaggcagcgctctcaggacatctccaccatggcctgggctctgctgctcctcaccctcctcactcgagggcacgagggtcctgggcccagtctcgccctgactcagcctgcctcgtgtcgtggtctcctggacagtcgatccactntctcngcacgtagaactagtgtgtacgtgatgtatatgactatcgtctcgttggttaccaacacctaccganaaccaaccgacccctaatcatttacttagttttaggaacgtactactaacgtccgaccttacgtaacgttactttcctctcgtcctttcgtctcctcctaacgtacgtcgacgaccgaaccgtcgtcccttactactaccgactcgtcgtacgctcagtcgaggacgacggtnacgttacgttattacttcgacgttacgtagttactaagtacgtaacggtaaccgggaccctaaccgtaacgtttaaccgttacggtttacgttaaccgggttaacgggttaaccggggtaaaccggggttaccggtaaaaccgggggtttcccccgtttaaccgggtttaaaccgggtaaccccgttttaacccgggaaacccgttaacccccccggggtaaaacccgaacccccccggtttaaaccccttaaaccccggggttcccgggtttaaaccccc

SEQ ID NO: 60705 - DNA, 662 bp, Homo sapiens
  misc_feature: GYAE6OF01CI49Y.37.74.G08.1.454.CMB.1.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtcctcccggacagtcgatccaccatcctccngcactggaaccagctagtgacgttggtgttaanaaatatgtctgttggtaaccaacatcaccaaacatccaacccaggaccaaaacgtacccccaaaatcctaattaaatttagtacgaaggttaccaacgttaaaaaccggcccctagaacgggtattttaccaaatcgtacctttcgcttggacctccgaaagttctaggaccaacgacggtccctacccgtgaccaactctcgtcgggtaccacctaaccgtcgaacggacgaggacctcgtaactaatttacgttagactacgctactaactacgtaactaagactacgacgtactaacgtttgggtcgttcgggacgggaacgggtacccgtaaccggtccggtaacccggtttacgttaacggttccgaacggaccccgtaaacgggtcccttaccgggtccccccgttccggg

SEQ ID NO: 60706 - DNA, 707 bp, Homo sapiens
  misc_feature: GYAE6OF01BC11H.37.74.G08.1.454.CMB.1.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (307)..(307): a, c, t, g, unknown or other
  misc_feature (307)..(307): n is a, c, g, or t
tcagtagtgtagatcacgaccggtgctcgatttagtagctctatcgagggggggggtctcaggaggcagcgctctcaggacatcctccaccatggcctgggctctgctgctcctccaccctcctcactcagggcacgagggtccgtcgggcccagtctcgccctgactcacgcctcgtccctcgttgtcgtcggtctccgtaggactcgtcgatccacctatcctccncgtcacgtacgaccacgctaggtggtacggttggtagtaataaatntgttctcgtacgtaccaanactaccaactaacnctaccaacccgaacggaactaaacccgtaccctaaacctactattaactttagaggtacgactaaccgtaacgccctagtacgtatttacacgtcgtcttccgtcgtcgtacctacgtaacgtcgtagggaaccaccggtaccgtcccctccgtaccgtaaccgtaccgttccgtcggtcccgggtacctaacccgtaacgtcgggaaaccggtacggaccggttaacctacctttaacggttacctttgtaacggctaccttaacctataaaccttactaaaccggtaagacccgttacggtaccgttcgtaacggttcgggttcggtagggtcccgggtacggtaccggtacgtccgtacgtcggtacgtacgaccgacgtaccgcctcccgtaccgg

SEQ ID NO: 60707 - DNA, 835 bp, Homo sapiens
  misc_feature: GYAE6OF01BGX1Y.37.74.G08.1.454.CMB.1.raw
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
  modified_base (317)..(317): a, c, t, g, unknown or other
  misc_feature (317)..(317): n is a, c, g, or t
  modified_base (427)..(427): a, c, t, g, unknown or other
  misc_feature (427)..(427): n is a, c, g, or t
  modified_base (499)..(499): a, c, t, g, unknown or other
  misc_feature (499)..(499): n is a, c, g, or t
tcagtagtgtagatcacgaccggtgctcgatttagtagctctatcgaggggggggtctcaggaggcagcgctctcaggacatcctccaccatggcctgggctctgctcgcctcctcaccctcctcactcgagggccacgacgggtccctcgggccctaggtcttacgcccctgactcgacgcctgtccctcgtgtcgtcggtcctccgtaggactaggttaccacttcccaacctnttccctccgtagccgtaccgtacggaaaccngtaccgtaggtcggttaacggttttgggtaaggtttaaaaataaacgttnttcggttcctttcggtttaccggaacctaacaacgttacccaaactacctaccgtaccaacccgaacggtaacctaaacccgtaccctaaatacctaagtttacgtttanacgggtacacctaaaccgtaccgtccgtagtagttacgttactaatccgttcttcgcgtcgactccgagtcncgacaccgtcccggtccctccgacgtacctactccgtcgtacggccctacctagggacgtacgacgtaccgtccttacgttaacgttacttagtacgaccgttactaactaaccgttaacttaaacccgggtataaacccgggtacttaaccggggtttaccccggacccggtttttaaggggttcccgggtttaaccgggggtccggggaaccccgggtaaacgggtcccccgtaaacccggggtttctaacccccgggtttaaggttaacccgggaacctaccccggggtaaacccgggtttcccggtcccccgggttcccgtacccccccggg

SEQ ID NO: 60708 - DNA, 747 bp, Homo sapiens
  misc_feature: GYAE6OF01A9QAG.37.74.G08.1.454.CMB.1.raw
  modified_base (219)..(219): a, c, t, g, unknown or other
  misc_feature (219)..(219): n is a, c, g, or t
tcagtagtgtagatcacgaccggtgctcgatttagtagctctatcgagggggggggtctcaggaggcagcgctctcaggacatcctccaccatggcctgggctctgctgcctcctcaccctcctcactcgagggcacgagggtcctgggcccagtctcgccctgactcagtcctcgcctcgtgtcgtgggtcctcgtgactggtcatcactactctccngactacgtacggaaccagcgtagtcggtaggtttggtagttaaataaagtgttcgttccttcgttaacggtaaccaatactaccaaaccaacactaccgaacccgaggaacctaaaaccgtccctaaaactctaattaattgacggtaacgtacctaaaccggtaaccggcccttagaacggtttacgtttacaacgtccgttcttccgtcgtacgtacctacgtaagtcgacggaacctaaccggtcctccctacgtacactcgttcgtcgtcggtccctaaccgtacgtacggaacggtacgaccggtactaaccgttaatttacgtttaacggtccgtactacggtccttaacgttaaactaacgtaacctacggtaccgtacgggtaccgttaaccgttggggggttaccggtttcggggtacccgggggtacggggtaaccggtacccgtcgggttaccggttacccggtacgtaccggtaacgaccggtacccggttacgtacccggttccccgtaccccgg

SEQ ID NO: 60709 - DNA, 717 bp, Homo sapiens
  misc_feature: GYAE6OF01C48ZU.37.74.G08.1.454.CMB.1.raw
  modified_base (107)..(107): a, c, t, g, unknown or other
  misc_feature (107)..(107): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (582)..(582): a, c, t, g, unknown or other
  misc_feature (582)..(582): n is a, c, g, or t
tcagtagtgtagatcacgaccggtgctcgatttagtagctctatcgaggggggggtctcaggaggcagcgctctcaggacatctccaccatggcctgggctctgctncctcctcaccctcctcactcagggccacgagggtcctcgggcccagttcctcgcccctagacctcagcctcgcccttccgtgtccgtggtcctaccgtggacagtcgatccaacctntcctcctgccaactggaaccngacctagtgaattattagaaaacttacttaaccgttgtccttcgtttaccggtaacccaaacaccgacccaacccgaaggacccaaaccccgaaccccctaaaactcagtacgttagtttgtaggaacggtaacgacggtaaacggcccgtaccccgttaggtacgggtttaactaacgttcctccgtttcctcgttccggaccttacgacgttcgacggaccctaccgacgtcccctacacgtaactcgttccgtccggtacgcccgtacgtacggacgtacggaccgggtaagcggtacttagttaattaacgtcgtactcggtactactagtcncgtaggtaccgtagttctaacttcgttacttcgttacgtaccgttaccgggagttaacccggggaacctaggttaaccctccggtaccgtaacgtacgaacccggaacccgaccgacccctacccgtcgtaaccg

SEQ ID NO: 60710 - DNA, 783 bp, Homo sapiens
  misc_feature: GYAE6OF01CJZWK.37.74.G08.1.454.CMB.1.raw
  modified_base (107)..(107): a, c, t, g, unknown or other
  misc_feature (107)..(107): n is a, c, g, or t
  modified_base (127)..(127): a, c, t, g, unknown or other
  misc_feature (127)..(127): n is a, c, g, or t
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (237)..(237): a, c, t, g, unknown or other
  misc_feature (237)..(237): n is a, c, g, or t
tcagtagtgtagatcacgaccggtgctcgatttagtagctctatcgaggggggggggtctcaggaggcagcgctctcaggacatctactaccagtggccgtgggctntgctgcctcctcaccctccncactcgagggacacgacgggtcctgggacccngtcctcgcctgactcncgcctcgcctcgttgtcgtcgggtcctccgtggaactgcgtactaccacctacttccgtccncgacctacggtacggaaccagtcgtaggttacggttacggtttaggggttaattaaacgtaaattagttacgttccgttaccgttaaccgggttaaacccaacctaacctaacctaacccctaactaccgtaccccgaacccgtaacggaaaccctaaacccgttaacccctaaactactaactttaattagacgtacgtaactaaccgtaacgacctacgagttaacgttctaacgtcttacgttctacgtcgtacacgtacgtcgtacgtaacgtaccgccgtcccgtaccgactacctcttcgtccgtacggtacctaccaacggacggtacgaccggacgttacctagtacttaatacgtcgttacgactcaacgtacctaacgttaacgacgttaccggacggtaccgttacgggtttaccgggtcgggtttacgggggtaccgggtaccgggtaccgggttaaccggtaccgtccgggttaacgttacggtacggtccgaacccgggaacgacccggttcccgtaaccccgggttccccg

SEQ ID NO: 60711 - DNA, 836 bp, Homo sapiens
  misc_feature: GYAE6OF01AD51Y.37.74.G08.1.454.CMB.1.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
tcagtagtgtagatcacgaccggtgctcgatttagtagctctatcgaggggggggtctcaggaggcagcgctctcaggacatctccaccatggcctgggctctgctgcctcctcaccctctcactcgagggcacgtagggtccctcgggcccagttcctcgccctagacctacacggcctgcccttccggtgttcgttcgggttcctccgtggacgtacggtaccgtacttacccaacctcttcccgttccgtacggcctaaccggttaacgggaaaccccgatccgtaggttaanaaccgtttagttaactaaaacctttaacgttaccgttttnttaccgttaccgttaacggtaacccaacgaccggacccaaccccggtaacggaaacccaaccccgtaaccccctaaacgttacgtacgtttacgtaacggtttaggacggaacggtaacctaaacgggttacgggacccggtacccgttacgggttacggggttttaacctaacgttccgtaccgtttaccgtccgtaaccggtcccgtacgtaaccggttacgacgtaaccgaaccggtaccgtccccgttacccgtacgaacgttaacgtaccgtcggtccggtaccgtacggtacggtcgtagggaccggtacggtacgtacgttacggtaactttacgtacgtcgggtacccttagtacccgtattacggtaacgtcggtaaccgttacggtaacttcgttaacgttacgttcgtacgtaccggtaacgacgttacggtaacgtaccggtctacccgaacgtcgaccgtaccacccgtaccgacctccgcgtaccg

SEQ ID NO: 60712 - DNA, 769 bp, Homo sapiens
  misc_feature: GYAE6OF01C754I.37.74.G08.1.454.CMB.1.raw
  modified_base (259)..(259): a, c, t, g, unknown or other
  misc_feature (259)..(259): n is a, c, g, or t
  modified_base (473)..(473): a, c, t, g, unknown or other
  misc_feature (473)..(473): n is a, c, g, or t
tcagtagtgtagatcacgaccggtgctcgatttagtagctctatcgaggggggggtctcaggagcagcgctctcaggacatctccaccatcggcctgggctctgctgcctcctccaccctcctcacgtcgacgggcaacgcgggtccgtcgggcccagtccgtcgccctcggactcacgtccgtcgtccgtcggtcggtcgtcgggttcctccgtaggactaggtcactacaccatccgtctcgcaacgtacggaaccngacgtagtacggtacggtttagggtaagtttaaattaagtagttcgtacgttacgtacgtaacctaacgactaccaaaccaactcctaaccgaaccccgaaggtaaccaaaaccgtaccctaaacctagtaagttaactttagacggtacgtaaccgacgtaacccgctacgtaagttacttacatcgttacttcgtcgtacgtccgttaacgngtaccgcggtaacctacccggaacccggttccctcctaaccgtaccttccgtaccgttcggtacccgggtaacccttaccgggaaaccgttacgggaacgtacccggttaccggtacctacgtaacgtttaatcggtacacgtactaccgaacttagaactaacgccgtacgtaacggtcttacggtaacggttggggtaccggtacggtaccggaacgggtaccctaacgggtccgttaacgttacgggtaaccgtccggaaccgtagtacccgggtcccttacccggtaccccg

SEQ ID NO: 60713 - DNA, 541 bp, Homo sapiens
  misc_feature: GYAE6OF02G9ANQ.37.74.G08.1.454.CMB.1.raw
  modified_base (223)..(223): a, c, t, g, unknown or other
  misc_feature (223)..(223): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtttctcctggacagtcgatcaccatctcctgcactggaaccngcagtgacgttggtgttaataaatatgtctcttggtaccaacatcaccaacatcacccaggacaaacgtccccaaactcaataatttatgagtcaactaaaccggccctacgaggtactttactaatcgctttctcgtggctccgaagtctggaccaacgaccggccttccctagacccattcctcgtcgggctccgaggtctaggacgacgaggctacacttattatgcagctacatatacaagcaagcatctagttgggtgtcgggcggacgggaccaccgtggaccgttcgttaggccacggacccgaggtcccg

SEQ ID NO: 60714 - DNA, 517 bp, Homo sapiens
  misc_feature: GYAE6OF02GUDIM.37.74.G08.1.454.CMB.1.raw
  modified_base (264)..(264): a, c, t, g, unknown or other
  misc_feature (264)..(264): n is a, c, g, or t
  modified_base (330)..(330): a, c, t, g, unknown or other
  misc_feature (330)..(330): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaanatcacaacatcacccaggacaaacgtccccaaactcataatttatgagtcaactaaacggccctanaggtatttctaatcgcttctctgctccaagtctggcaacgacgcctcctgaccatctcgtggctaccaacctgaggacgaggctcacttattatgcagctacatatacagcagctcacgttgggtgtcggcggagggacccacgtcgaccgttcgtacggtcacgaccctaaggtcctcgtcccccg

SEQ ID NO: 60715 - DNA, 493 bp, Homo sapiens
  misc_feature: GYAE6OF02INBUE.37.74.G08.1.454.CMB.1.raw
  modified_base (303)..(303): a, c, t, g, unknown or other
  misc_feature (303)..(303): n is a, c, g, or t
tcagtagtgtagatcacgaccggtgctcgatttagtagctctatcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaacatcaccaacatcacccaggcaaagtccccaaatcataatttangagtcactaaacggcctacaggattctaatcgcttctctggctcaagtctggcaacacggcctcctgaccatctctggctccaactgagacgagctcactatatgcagctcatatacaagcagcagtcacgttgggtattcggcggagggccgacctgaccgttcgttaggtcacggcccaggctaccgg

SEQ ID NO: 60716 - DNA, 526 bp, Homo sapiens
  misc_feature: GYAE6OF02F77KT.37.74.G08.1.454.CMB.1.raw
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaaactcaataatttatgaggtcactaaacggccctacaggagtttctaatcgcttctctggctccaagtctggacaacacggcctccctgaccatctctggctccaactgaggacgaggctcacttattattgcagctcatatacaagcagcatcacgtttgggtgttcgggcggacgggacccgaccgttcggaccgttcgttacggtccaggccccgtaaggcctcccgg

SEQ ID NO: 60717 - DNA, 543 bp, Homo sapiens
  misc_feature: GYAE6OF02GS53M.37.74.G08.1.454.CMB.1.raw
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttggtaccaacatcaccaacatcacccaggcaaacgtccccaaactcataatttatgagtcactaaacggccctacaggagtttactaatcgtcttctcttggctccaagtctggacaacaccggccctcctgacctatctcgtcgggtcctaccaacctgaacggacgacggtcctcacttattatgcagctcatatacagcagctcattgggtgttcgggcggaacgggtacccgacgtcgtaccgttcgttacggtcaccgtcccgaacggtcctaccggtcccccg

SEQ ID NO: 60718 - DNA, 516 bp, Homo sapiens
  misc_feature: GYAE6OF02G43TU.37.74.G08.1.454.CMB.1.raw
  modified_base (223)..(223): a, c, t, g, unknown or other
  misc_feature (223)..(223): n is a, c, g, or t
  modified_base (397)..(397): a, c, t, g, unknown or other
  misc_feature (397)..(397): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttggtaccaacatcacccaggcaaagtccccaaactcatgatttatgaggtcactaaacggcctcaggggtctctaatcgcttctctggctccaagtctggcaacacggcctcctgaccatctctgggctccaggctgacgacgnggctcacttattattgcagctcatatacagcagcatcacgttgggtgttcgggcggtacgggaccgaccgtcgaccggtcgttacggtcagcccgaaggcctcgtcccccgtggtaccc

SEQ ID NO: 60719 - DNA, 514 bp, Homo sapiens
  misc_feature: GYAE6OF02FXM7U.37.74.G08.1.454.CMB.1.raw
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataatttangagtcaactaacgcctnaggatttctaatcgcttctctgctcaagtctgcaacacgcctcctgaccatctctggcctccaacctgaggacgaggctcactattatgcagctcatatacagcagctcacgttgggtgttcggcgggtagggacccgtaccgtggacccgttcgttacggtccacgccccgaaggtcctcggtccccccg

SEQ ID NO: 60720 - DNA, 580 bp, Homo sapiens
  misc_feature: GYAE6OF02HUCRM.37.74.G08.1.454.CMB.1.raw
  modified_base (245)..(245): a, c, t, g, unknown or other
  misc_feature (245)..(245): n is a, c, g, or t
  modified_base (461)..(461): a, c, t, g, unknown or other
  misc_feature (461)..(461): n is a, c, g, or t
  modified_base (510)..(510): a, c, t, g, unknown or other
  misc_feature (510)..(510): n is a, c, g, or t
tcagtagtgtagatcacgaccggtgctcgatttagtagctctatcaggggggtcgtcgaggaggcagcgctctcaggacatctccaccatggcctgggctctgctgctcctcaccctcctcactcaggcacaggtcctgggcccagtctgccctgactcagcctgcctccgtgctggtctctcggacagtcatccacatcgcctagcactggaaccagcagttgacgttggtgtaatactatgtntctggtacaacatcaccaggacaaacgacccaaactacactagattatgtagtcaacttaaacgacctacgtaagggtctacctaaatcgtacctctctcggtctacctaagtcctggctaacgaacggcctccctacgaccctaagtcttctgggtccttccaacgggcttggaccggaacgtaacgggctaccgaacctaatttaatcggttanacgtcacctattaactaaccagaacaacgtccgtaactaattccgggtnttcgggcggagggtacccgaaccgtgaccgtcgttacgcttacggccaacggctacgccccttggacccg

SEQ ID NO: 60721 - DNA, 533 bp, Homo sapiens
  misc_feature: GYAE6OF02GBFAA.37.74.G08.1.454.CMB.1.raw
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataaatatgtctcttggtaccaacatcacaacatcacccaggcaaacgtccccaaactcataattangagtcaactaaacggccctnaggtagttctaatcgcttctctggctcaagtctggacaacgacgcctcctgaccatctctgggcctccaacgtgacggacgaggctacacttattatgcagctacatactacaacgcagtcgtacacgttgggtcgttcgggacgggacgggaccgaccgtcggaccgtgttacggtcacgtacccgaaggtcctcggtcccccg

SEQ ID NO: 60722 - DNA, 511 bp, Homo sapiens
  misc_feature: GYAE6OF02F3AKP.37.74.G08.1.454.CMB.1.raw
  modified_base (481)..(481): a, c, t, g, unknown or other
  misc_feature (481)..(481): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcaagcgtcacttgggtgttcggcggaagggaccgacgtgaccgtnttacggtcagcccaaggtcctcgtcccccg

SEQ ID NO: 60723 - DNA, 524 bp, Homo sapiens
  misc_feature: GYAE6OF02FSXTR.37.74.G08.1.454.CMB.1.raw
  modified_base (299)..(299): a, c, t, g, unknown or other
  misc_feature (299)..(299): n is a, c, g, or t
tcagtagtgtagatcacgaccggtgctcgatttagtagctctatcaggggggggtctcaggaggcagcgctctcaggacatctccaccatggcctgggctccgctgctcctcaccctcctcactcagggcacagggtcctgggcccagtctgccctgactcagcctgcctccgtgtctggttctcctggacagtcgatcaccatctcctgcactggaaccagcagtgacgttggtggttataaatatgtctcttggtaccaacatcaccaacatcacccaggcaaagtccccaaaactnaccctaatttatgaggtcactaaaacggccctcaggagtttctaatcgcttctctggctccaagtctggcaacacggcctccctgaccatctctgggcctccaacctgacggacgaggctcactattattgcagctcatatacaagcagcgtcacgttgggtgttcggcggagggaccgaccgtcgaccgttcgttaggtcacgcccgaaggcctcgcccctcgg

SEQ ID NO: 60724 - DNA, 509 bp, Homo sapiens
  misc_feature: GYAE6OF02FMKWQ.37.74.G08.1.454.CMB.1.raw
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
  modified_base (425)..(425): a, c, t, g, unknown or other
  misc_feature (425)..(425): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggaaaacgtccccaaactcataattatgaggtcactaaacggcctnaggagtttcaatcgcttctctggctcaagtctggcaacncggcctcctgacaatctctgggctcgagctggacggacgagctgattatactgctgctnatatgacaggtatcacttcttagtgttcgttacggaactgggacctaaggtcaccgtctaagtccacgcccaggccctaacccg

SEQ ID NO: 60725 - DNA, 617 bp, Homo sapiens
  misc_feature: GYAE6OF02GCAIJ.37.74.G08.1.454.CMB.1.raw
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
tcagtagtgtagatcacgaccggtgctcgatttagtagctctatcgagggggggggtctcaggaggcagcgctctcaggacatcctccaccatggcctgggctctgctgctcctcaccctcctcactcgagggcacgagggtcctgggcccagtctgccctgactcagcctgcctcgtgtctgggtctcctggacagtcgatccaccatcctcctgcactggaaccagcagtgacgttggtagttaataaatatgtcttcttggtaccaacatcaaccaacatccacccaggacaaacgtccccaaactcataatttangagtcactaacgcctnaggtagtttactaatcgcttctctggctaccaagtcgtggaccaacgaccggtccctccctcgacctactccgtcgtcgggcctaccgaaccgtgacgggacgaggtctctaacttatttaacgttgcctagtcctactaattactaacgaacgacgtagacccgttactaacggttgggttacgttccgggacgggaacggggtaacccgtacccgtacggtacccgtttacgttaacggtccggaacggacccgtaacggtccgtacccgtaccccccgg

SEQ ID NO: 60726 - DNA, 513 bp, Homo sapiens
  misc_feature: GYAE6OF02IHTDT.37.74.G08.1.454.CMB.1.raw
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtgttataactatgtctcttggtaccaacatcacccaggcaaagtccccaaactcatgatttatgaggtcactaaacggccctcaggggtctctaatcgcttctctgctcaagtctggcacacggcctccctgaccatctctgggctccaggctgacgacgaggctcacttattattgcagctcatatacaagcagcatcacttgggtgttcgggcggagggccgacctggaccgtcgttaggtccagcccgaaggccgtacgccccccgtggtacccg

SEQ ID NO: 60727 - DNA, 509 bp, Homo sapiens
  misc_feature: GYAE6OF02HD2V0.37.74.G08.1.454.CMB.1.raw
  modified_base (305)..(305): a, c, t, g, unknown or other
  misc_feature (305)..(305): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcaccaggcaaagtccccaaatcataatttangagtcactaaacggcctcagagtttcaatcgcttctctgctcaagtctggcacacggcctcctgaccatctctgggctccaacctgacggacgaggctacactattatgcagctcatatacaagcagcgtctacgttgggtcgttcggcggagggacccgacgtcgaccgttcttacggtcagacccaaggtctacgtcccccg

SEQ ID NO: 60728 - DNA, 611 bp, Homo sapiens
  misc_feature: GYAE6OF02I95QN.37.74.G08.1.454.CMB.1.raw
  modified_base (252)..(252): a, c, t, g, unknown or other
  misc_feature (252)..(252): n is a, c, g, or t
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
tcagtagtgtagatcacgaccggtgctcgatttagtagctctatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctnttggtaccaacatcaccacatcacccaggacaaacgtccccaaaactcataatttatgaggtacaactaaacggccctanaaggtagtttactaatcgctttctntggctcaagtctaggacaacgaccggccttaccctgaaccctattcgtaccgtgggccctactaacccgtgaacgggacgaaggcctactacgttattactgaccaacgcttaccattaactaacaacgtacaggtctactacgtttggggtacgtttcgggaccgggtaacggggacccgtaccgttaccggaccgtttaccggtttacgggctacccggacccgaaacgggttccgtacccggttccccccg

SEQ ID NO: 60729 - DNA, 561 bp, Homo sapiens
  misc_feature: GYAE6OF02GZ0ID.37.74.G08.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (308)..(308): a, c, t, g, unknown or other
  misc_feature (308)..(308): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttaataatntgtctcttggtaccaacatcaccaacnctcaccaggacaaacgtcccaaactcaataattangagtcaactaaacggccctagaggtagtttactaatcgtcttctctcgctaccaagtctggacacgcggcctccctgacctatctcgtcggctaccactggacgacgacgctactactattatcgacacgtctacatactaacaagcacggtcgtactacgttgggttagttcgggacgggacgggacccgtacgtccggaccgtttcgtacgggtcaaccggtcccgaacggtccgtacccggtacccccgg

SEQ ID NO: 60730 - DNA, 518 bp, Homo sapiens
  misc_feature: GYAE6OF02F6OAF.37.74.G08.1.454.CMB.1.raw
  modified_base (384)..(384): a, c, t, g, unknown or other
  misc_feature (384)..(384): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcagggtctctaatcgcttctctggctcaagtctggcaacacggcctccctgaccatctctggctcnggctgacgacgagctcactattattgcagctcatatacagcagcatcacgttgggtgttcggcggacgggaccgtaccgtcgtaccgtcgttacggtcacggcccgaaggcctccggtaccccctcggtacccg

SEQ ID NO: 60731 - DNA, 553 bp, Homo sapiens
  misc_feature: GYAE6OF02FXDBL.37.74.G08.1.454.CMB.1.raw
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaactcataatttatgagtcactaaacggccctnaggagtttctaatcgcttctctggctcaagtctggcaacnccggccctccctcgaccatcctcgtcgggcctaccaacctgacggacggaggcctacacttattacttgcagctacatactacaacgcacgcgtctacgttgggttcgttaccgggcgggtaacggggaccgaccgtcgtaaccgttcgttacggtcacggtcccgaacggtcctccgtcccccg

SEQ ID NO: 60732 - DNA, 574 bp, Homo sapiens
  misc_feature: GYAE6OF02GLT3J.37.74.G08.1.454.CMB.1.raw
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctccgtgtctgagtctcctggacagtcgatcaccatctcctgcactggaaccagcagtgacgttggtggttataaatatgtctcttggtaccaacatcaccaacatcacccaggcaaaacgtccccaaactcaattaatttatgacggtacactaaaaccggccctacgaggtatttactaatcgcttactctggctccaagtctcggcaacgaccggcctccctcgaccatcctcgtcgggtcctaccgaaccgtggacggacggaggcctcaacttattattgcagctacaatactaacaacgcacgtcgtactacgttgggttcgttcggggacgggacgggacccggtacctcggtaccgttacgttacggtccgacggacccgtaacggtccgtcccgg

SEQ ID NO: 60733 - DNA, 695 bp, Homo sapiens
  misc_feature: GYAE6OF02G7KR2.37.74.G08.1.454.CMB.1.raw
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataatatgtctcttgtaccaanatcaccaacatccacccaggacaaacgtcccaaactcaataatttangaggtcaacgtaaaccggccctacgaggtagtttactaatcgtcttctctggctacaagtctcggacaaccgaccggtccctcccgtacgaccctacttctcgtcgggtccctaccgaaccgtggaacggaccgacgggtaccttaccgtaacttaacgtttacgtttacgacctacgtaccttacaacgttaacttaacgaaacgtccgtaacggtaccgttaccgtaacggtttcgggggtttacgggtttaccgggggaccggggtaaaccgggggtaccccggtaacccggttaccgggtaacccggtttacggtttaaccggggttccgaacccggttaccccggtaaacgggtccccggttaccccggtacccccccggg

SEQ ID NO: 60734 - DNA, 567 bp, Homo sapiens
  misc_feature: GYAE6OF02IQI7Y.37.74.G08.1.454.CMB.1.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataatatgtctcttggtaccanatcacaacntcaccagcaacgtcccaactcataattatgagtcactaacgcctnagatttctaatcgcttctctcggctctaagtctgcaacnccggcctccctgacctatctcgtcggcctaccgacctgacggacgaggctccacgttattattcgactagtcctactagtaactacgaacgacgtacgtcgtacgttacgttgggttacgttccgggacgggtacggggtacccggtaccgtcggtacccgttacgtttacggtccgtaccggacccgaacgggtccctaccggtccccccgg

SEQ ID NO: 60735 - DNA, 553 bp, Homo sapiens
  misc_feature: GYAE6OF02H8SH1.37.74.G08.1.454.CMB.1.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccatctcctgcactggaaccngcagtgacgttggtgttaataatatgtctntggtacanatcacacatcaccaggacaaacgtccccaaatcaattaattangagtcaactaaacggcctanaggtatttacaatcgcttctctggctaccacgtctaggccaacgcggtccctccgtgaccatctctcggcctccaacgtgaggacgaggctacacttattactgctagctacatatacacgcagtcgtacgtacgttgggttcggttccgggacgggtacgggacccgtaccgtacggtacccgttacgttacggtacaccggtacccgaaggtccctccggtccccccgg

SEQ ID NO: 60736 - DNA, 519 bp, Homo sapiens
  misc_feature: GYAE6OF02FNKSN.37.74.G08.1.454.CMB.1.raw
  modified_base (220)..(220): a, c, t, g, unknown or other
  misc_feature (220)..(220): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
tcagtagtgtagatcacgaccggtgctcgatttagtagctctatcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataaatatgtctcttggtaccaacatcaccaacatcacccaggcaaagtccccaaactcataatttangagtcactaaacggccctnaggatttctaatcgcttctctggctcaagtctggcaacacggcctcctgaccatctctgggctccaacctgacggacgaggtctcactattatgcagctacatatacaagcagcgtcacgttgggtcgttcggcgggacggaccgaccgtcggaccgttcgttacggtcacggcccgaaggtcctcgtcccccg

SEQ ID NO: 60737 - DNA, 610 bp, Homo sapiens
  misc_feature: GYAE6OF02I03L7.37.74.G08.1.454.CMB.1.raw
  modified_base (223)..(223): a, c, t, g, unknown or other
  misc_feature (223)..(223): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtggttataactatgtctcttggtaccaacatcacccaggcaaacgtccccaaactcatgatttatgaggtcactaaacggccctacaggggtctactaatcgcttctctgctcaagtctggcacacggcctcctcgaccactctacgtcggctcgacggctcggacgtacgacggctccgacttaatttacgttcgcgtagccttcacttaagttaaccaaggccaggactacgtacctacggtttaggggttcggtttcgggacggggtaacggggtacccggtaacccggttacggtaacccggttccggttaacggttacgaaccggaccccggtaaacggtccgtacccggccccccgttacggttaacccg

SEQ ID NO: 60738 - DNA, 639 bp, Homo sapiens
  misc_feature: GYAE6OF02H5Y04.37.74.G08.1.454.CMB.1.raw
tcagtagtgtagatcacgaccggtgctcgatttagtagctctatcaggggggggggtctcaggaggcagcgctctcaggacatctccaccatggcctgggctctgctgctcctcaccctctcactcagggcacagggtcctgggcccagtctgccctgactcagcctgcctccgtgtctgggtctccgtggacagtcgatcaccatctcctgcactggaaccagcagtgatattagaaaacttataaacctttgtctcttggtaccaacagcacccaggcaaaacgccccaaactcatgattgtgagacagtaagcggccctgtagggttctaatcgtcttctctggctaccaagtctaggaccaacacgggccctacccgtgaactaatccgtcgtcgggcctaccgaggtctaggaacgggaccggagggtacttaggtaattttacttaaccgtgtacgttgaccttacgaattaacgtggacgtaagggttacgttactaccgttatttaacgttgttaccgtttacgggaaccgtttaggggaaaccctaaacggggttacccaacccggtttaacccgtaagttcccgaacggtaaccccgaacgggaacccctaacccccgtatttacccgg

SEQ ID NO: 60739 - DNA, 575 bp, Homo sapiens
  misc_feature: GYAE6OF02IS495.37.74.G08.1.454.CMB.1.raw
  modified_base (221)..(221): a, c, t, g, unknown or other
  misc_feature (221)..(221): n is a, c, g, or t
  modified_base (339)..(339): a, c, t, g, unknown or other
  misc_feature (339)..(339): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtagttaataaatatgtctcttggtaccaacatcaccaacatccacccaggacaaacgtccccaaactcaattaatttagtgtagtactaactaaaccggccctanaggtatttctaatcgtcttctctgctcaagtctggcaacgccgtcctcctcgacctatctcgtcggcctaccgaacctgacggacgagtctactacttattacttcgctagtctacatactaacaagcgagtcgtcgtacgttgggtacgttcgggacgggtaacgggacccgtacggtacgtaccggttacgttacgggtaccaccgacccgtaacgggtcctccggtcccccgg

SEQ ID NO: 60740 - DNA, 703 bp, Homo sapiens
  misc_feature: GYAE6OF02GBF15.37.74.G08.1.454.CMB.1.raw
  modified_base (225)..(225): a, c, t, g, unknown or other
  misc_feature (225)..(225): n is a, c, g, or t
tcagtagtgtagatcacgaccggtgctcgatttagtagctctatcagggggggggtctcaggaggcagcgctctcaggacatctccaccatggcctgggctctgctgctcctcactctcctcactcaggacacagggtcctgggcccagtctgccctgactcagcctgcctccgtgtctgggtctccgtggacagtcgatcaccatctcctgcacgtcggaaccngcagtgatattagtaaacttataaccttgtcttcgttacggtaccaacacgccacccaggaccaaacgacccccaaactccatcgtatttggagaggacaggtaacggccggcccttacggtacggggttttactaagttccgtctttccgtcttcgggtcctaccgtaaggtccgtagggaccaaccgaaccggtccccttcccgtacgtaacctaaacttccgttaccggtcgggtcctacccggtacggcgttagggaaccgggtaccggacgggtaccgtaggttaacttttaacgttaccgtacggtccttacggacttacgtaacgttagttacggcgttaacgggttacttaccgtactttacgtttacgttgttaccggttacggtaaccggtacgggtaaccgtaacggtccctaaccgttaccgtaacggtaccgaaccggacccgtaaccggaccccaacccgtacg

SEQ ID NO: 60741 - DNA, 822 bp, Homo sapiens
  misc_feature: GYAE6OF02GS2UO.37.74.G08.1.454.CMB.1.raw
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
tcagtagtgtagatcacgaccggtgctcgatttagtagctctatcgagggggggggttcgtcaggaggccagcgcgtctcaggacatcgtccaccatgggccctgggctctgcctggctcctcaccctcctcactcgagggccacgagggtccctgggcccaggtctgccctgactcagcctgcctcgtgtctggtctcctggacagtcgatcgacatctctgacatcgaacctgcgagtgacgttggtagtaataatntagttcttcgtggttaccaanactacgaaaccaacgactaccaacccgaggaccaaacggtacccctaaacttcctaacgttaactttaactacggtaacgtaaccgtaaccgtaaacccggacccttaacggtaaggtacgtttaaccgtaagttccgtacgtttacctcggttcgggacctaccgtaaacgttccgttacggaacctaaacccggtacccggtaccctacccgtacggaaccctacgttacccgtccggttcgggtaccctacccgtaaccgtcggtaacggggtaccgtaacggttaccttacgtaaccgtttaagttaacgttacggaccgttacgtacccgtttaaccctaacgttaaccgttacgaaaccggtcctaaccgggtaccttaccggttaaccggttttaggggttacccgggttttacggggaccggggttaaaccggggtaccccgtaacggttcccggttaacccggtttcgtttaacccgggttcgttaaccggtaccccgtaaacgggttccccggttaccccgttaccccccgg

SEQ ID NO: 60742 - DNA, 679 bp, Homo sapiens
  misc_feature: GYAE6OF02I22VW.37.74.G08.1.454.CMB.1.raw
  modified_base (224)..(224): a, c, t, g, unknown or other
  misc_feature (224)..(224): n is a, c, g, or t
tcagtagtgtagatcacgaccggtgctcgatttagtagctctatcagggggggggtctcaggaggcagcgctctcaggacatctccaccatggcctgggctctgctgctcctcaccctctcactcagggcacgagggtcctgggcccagtctgccctgactcagcctgcctccgtgtctgggtcctccgtggacagtcgatcaccatctcctgcactggaaccngcagtgtacgttggtgttaataaatatgtcttcttggtaaccaacactacaaccaacactaccacccaggaccaaacgtaccccctaaaactctaattaaactttagtagtaacggtaccaaccgttaaaccggccctacgaaggttacgtttactaatcgtcttactcgtcggtctaccgaagtcgtcggaccaacgaccggtccctcccgtacgacctactcgtcgtcgggtaccctccgtaacgtgacggacgacggtactacgtacttattacttcgactacgtactactaataactaacgaacgacgtacgtccgttacgtacggtttcggggttcggttaccggggacggggtaaccggggtacccgtaccggttaaccgggtaccggttacgttttaccgggaccgaccggtaccccggtaacgggtccctaccccggtaccccccgg

SEQ ID NO: 60743 - DNA, 539 bp, Homo sapiens
  misc_feature: GYAE6OF02I8FKS.37.74.G08.1.454.CMB.1.raw
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatcctcctgccactggaaccngcagtcgacgttggtaggttaataatatgtctcttggtaccaanatcaccaacatcacccaggccaaacgtcccaaactcactaattatgagtacaactaaccgacctcgagggtctctaagtcgacttntctgctcagtcngcaacncggtcctcctcgacactctctggtcctcacgctcgacgtacgaggcttcaacttntacttgactcgctacattaacgtacaacncaagccaatccgtagtttagggtcgttacgggccgggacgggtacgaccgtcgacgttcgtacgcctacgacccggtagtcccg

SEQ ID NO: 60744 - DNA, 601 bp, Homo sapiens
  misc_feature: GYAE6OF02GRFCL.37.74.G08.1.454.CMB.1.raw
  modified_base (222)..(222): a, c, t, g, unknown or other
  misc_feature (222)..(222): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctctgcactggaaccngcagtgacgttggtaggttataaatatgtctcttggtaccaantcaccaanctcacccaggacaaacgtccccaaactcaataattanggagtacaactaaaccggcctagaggtagtttctaatcgtcttctctcggctaccaagtcgtgacaacgccggcctccgacgacctntccgtcgtcggtcctccgtaacctggacggacggnggtactcgaacttagttactgcacgtctactactaataccgaagaccaacggtcgtaacgttacggttagggttcggtccggacggggtacgggtaacccgtccggtaaccggtaccgttcggtaacgtccgtacggtaccccaagggttcctacccggttacccccgg

SEQ ID NO: 60745 - DNA, 549 bp, Homo sapiens
  misc_feature: GYAE6OF02H3SOH.37.74.G08.1.454.CMB.1.raw
  modified_base (265)..(265): a, c, t, g, unknown or other
  misc_feature (265)..(265): n is a, c, g, or t
  modified_base (330)..(330): a, c, t, g, unknown or other
  misc_feature (330)..(330): n is a, c, g, or t
tcagtagtgtagatcacgaccggtgctcgatttagtagctctatcaggggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcaccatctcctgcactggaaccagcagtgacgttggtagttaataaatatgtctcttggtaccaanatcacaacatcaccaggcaaacgtccccaaatcattaattatgagtcaactaacgccctcaggtntttactaatcgtcttctctgctacagtctggacaacacggccctcctgaccctatctcgtggcctaccaacctggacgacgacggctacatattatgctagctacatactaacaagtcagtacactactacgtttgggtcggttcgggacgggtacgggacccgtaccgtacggacccgttcgttaacggtccacggtacccgtaggcccgttacccgg

SEQ ID NO: 60746 - DNA, 569 bp, Homo sapiens
  misc_feature: GYAE6OF02HBVAT.37.74.G08.1.454.CMB.1.raw
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtnatattgaaacttataaccttgtctcttggtaccaacagcaccaggcaaacgccccaaactcatgattgngaggacagtaagcggcctcgtaggggtttctaatcgtcttctctggctcaagtctggacaacgcgcctcctgacaatctcgtcggctccgaggtctaggacggacggaggtctagtaactttattacgtgtctgtcctactagtattcggacgtagggttacgtctacttcttattcgttcgttacgggtaacgttacgggtaacctaacggttaccgaaccgttaccgttaagtccgaacggacccaacggtcccctaaccctcgttaccg

SEQ ID NO: 60747 - DNA, 777 bp, Homo sapiens
  misc_feature: GYAE6OF02F4KS0.37.74.G08.1.454.CMB.1.raw
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtagttaataatatgtcttcgttaggtaccaacatccaaccaacatccaacccaggacaaaccgtaccccaaactacaataactttatagtacggtacaaccgtaaaccggccctagaggtacgtttactaatcgtacttctcgtacggtcctaccgtaagttccgtacggaaccctaaacggtacccggtccccttaccccgtacgtaacccctacgttaccgttaccggttcggggaccccttaaccccgtaaaccggttacgggaaccggggaccgggtaacggtcccgttaccgtaaaccgtttaagtttaacgtttacgacgtaacgtacccttacgtaattaaacttaaccgaaacgtaccgtaacgtaccgttaaccgttaccgggtttacggggtttacgggttaccgggggaccggggtaaccgggggtaaccccgtacccgggttaccggttaaccccggtttacggttaccgggttacccgtaaccggtaccccggtaaccgggtcccggttaccccggtacccccccgg

SEQ ID NO: 60748 - DNA, 549 bp, Homo sapiens
  misc_feature: GYAE6OF02F7TTD.37.74.G08.1.454.CMB.1.raw
  modified_base (222)..(222): a, c, t, g, unknown or other
  misc_feature (222)..(222): n is a, c, g, or t
  modified_base (302)..(302): a, c, t, g, unknown or other
  misc_feature (302)..(302): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgatattagaaacttataaccttgtctcttgtaccaacagcaccaggacaaacgacccccaaactcatgtatttgngaggacagtaacgcgcctgtagggtttctaatcgtcttctctggctacgaagtctcggacaacgaccggtcctccctagacactctcgtcgggctccgaggctggacgggacgacggctagtatttacttctgtctcgctacatagtgcgtaggtacttctacttcttagttcgtcgttacggacgtcgggaacctaggtcctaccgtacgtacgtcgacgacccgaacggaccctacccgactacg

SEQ ID NO: 60749 - DNA, 696 bp, Homo sapiens
  misc_feature: GYAE6OF02IA416.37.74.G08.1.454.CMB.1.raw
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggacagtcgatcaccatctcctgcactggaaccagcagtgacgttggtaggttaataatatgtctcttaggtaccaacatcaccaacactaccacccaggactaaacgtacccccaaaactacaattaacttttataggtaggtacaaccgttaaaaccgggcccctacgaacgggttaacgttttactaacttccgtcctttcttcgtcggtccttaccgtaacgtcgtacgggaccaaaccgtaccgggtccccttcccgtacgaaccctacttccttccgtcgggaccttacccgaaaccgttacgggaacgggaacggtacggtaccgttactaactttaagttttagtacgacctacgtccttaaccaattaactaacacgtaccgacgtccgtactacggtttggggtacggtttcgggaccgggacggtacccgtcgtaccggtaccgttcgttacggtccgaaccgacccggtaaggtcccgtacccggtaccccccgg

SEQ ID NO: 60750 - DNA, 583 bp, Homo sapiens
  misc_feature: GYAE6OF02H91WB.37.74.G08.1.454.CMB.1.raw
  modified_base (224)..(224): a, c, t, g, unknown or other
  misc_feature (224)..(224): n is a, c, g, or t
  modified_base (313)..(313): a, c, t, g, unknown or other
  misc_feature (313)..(313): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctcctgccactggaaccngcagtgacgttggtagttaataatatgtctcttggtaccaacatcaaccaacactacaccagacaaacgtacccaaactcataatttangacgtcaacgtaaaccggcctacgagtacgtttactaatcgtctctctgctacagtctgcaacaccgtcctccgtgacctatcgtcgtcggctaccaacgtgacggacgagtctactacttattagtgacgagccttacatactaaacgagacgaagtccgtacgtacgttgggttacggttccgggacgggtaacgggacccgtaccgtacggtacccgttcgttacggtaccgtaccgacccggaacggtccgtacccggtcccccgg

SEQ ID NO: 60751 - DNA, 533 bp, Homo sapiens
  misc_feature: GYAE6OF02FFMQB.37.74.G08.1.454.CMB.1.raw
  modified_base (253)..(253): a, c, t, g, unknown or other
  misc_feature (253)..(253): n is a, c, g, or t
  modified_base (377)..(377): a, c, t, g, unknown or other
  misc_feature (377)..(377): n is a, c, g, or t
tcagtagtgtagatcacgaccggtgctcgatttagtagctctatcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtggttataaatatgtctnttggtaccaacatcaccaacatcacccaggcaaagtccccaaatcataattatgaggtcactaaacggccctacaggagtttctaatcgcttctctggctcaagtctggcaacacggccctccngaccatctctgggctccaacctgaggacgagctcacttattattgcagctacatatacaagacagctctacgttgggtgttcggcggacgggaaccgccgtacgaccgttcgttacggtaccacggtacccgaacggtccgtcgtcccccgtccgg

SEQ ID NO: 60752 - DNA, 536 bp, Homo sapiens
  misc_feature: GYAE6OF02G3AT9.37.74.G08.1.454.CMB.1.raw
  modified_base (222)..(222): a, c, t, g, unknown or other
  misc_feature (222)..(222): n is a, c, g, or t
  modified_base (360)..(360): a, c, t, g, unknown or other
  misc_feature (360)..(360): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataaatatgtctcttggtaccaacatcaccaggcaaagtccccaaactcatgatttatgaggtcactaaacggccctcgaggggtctctaatcgtcttctctggctccagtctggacaacncgcctcctgaccatctcgtgggctccgaggctgacgacgacggctcactattatgcagctcatatacagcagctaacgtctacgtttgggtcgttcgggacgggtacgggacccgtaccgtcggtaaccgttcgttacggtcacggacccgtaagggcctccggccccgttaccgg

SEQ ID NO: 60753 - DNA, 632 bp, Homo sapiens
  misc_feature: GYAE6OF02G9ATS.37.74.G08.1.454.CMB.1.raw
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgcgtctgggtctccgtggacagtcgatcaccatctcctgcactggaaccagcagtgacgttggtgttaataatatgtctgttgaccaantcaccanatccacccaggacaaacgtccccaaactcaataattatgagtacaactaacgcctagagtacgtttacaatcgtcttcnctcggtcctaccgaagttcgacggacaacccgaccggcccttcccgtagacccctagtccttccggtcgggtacccttacccgaaccgtagggaaccggacggacggtcctacgtacttatttactggactagctactaagtactaaccagacaaggtcgtacgttacggttcggggttctaccgggggacggaacgggtacccgtacccgttacgggtacccgtttcgtttaacgggacctaaccggttacccggaacggtcccgttacccggtaccccccgg

SEQ ID NO: 60754 - DNA, 527 bp, Homo sapiens
  misc_feature: GYAE6OF02I0A1A.37.74.G08.1.454.CMB.1.raw
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtaggttataaatatgtctcttggtaccaacatcaccaacatccacccaggcaaagtccccaaatcaataatttatgagtcactaacggccctnagtagttactaatcgcttctctgctcaagtctggcaacncgtcctcctgaccatctcgtggcctccaacctgacggacgacggtctctaacttattattcgcagtctacataatacaagcagctactgttgggtgttcggacggaggtacccgacgtcgaccgttgttacggtcaccggtccaaggtcctccgtcccccg

SEQ ID NO: 60755 - DNA, 692 bp, Homo sapiens
  misc_feature: GYAE6OF02IOY8L.37.74.G08.1.454.CMB.1.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgacctcagcctgcctccgtgtctgggtctccgtggacagtcgatccaccatctccctgcactggaaccngcagtgacggttggtgttataaatatgtctcttggtaccaanatcaccaacatccacccgagaccaaacgtacccctaaactcatgtatttgtagaggacaggtaacgccgccgtcgaggtttctaagtccgtctttctcgtcggtccttaccgaagtctacggacctaaacccgtccgggtcccttcccgtacgaacctaaacttcccgtcgtaccggggtccctccggaacgggtccctaccggaaccggaaccggtacggtccgtacctaacgtttactttacgttcggacctaacgtccttacaaagttaacgtaaacgaacgtacgaaccgactaaccgttaccgtacgggttttacggggtcggtttacccgggggacgggtaaccggggtaccccgttaaccgtccgggttacccggtttaccggttacggtacccggtaccccggaccggtaacccgg

SEQ ID NO: 60756 - DNA, 806 bp, Homo sapiens
  misc_feature: GYAE6OF02F5O8V.37.74.G08.1.454.CMB.1.raw
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctcgccctgactcagcctgcctccgtgtctgggtctccgtggacagtcgatcaccatctcctgccctaggaaccagcagtgattattagaaacttactaaccttgtccttcgttacggtaaccaacgtacgaccaacccgaggaccaaaccgaccccccaaactcaatcgtaattttggaggaggaacaaggttaacggccggtccctacgagggttagttttactaacgtccgtctttactcgttcggtcctaccgtaaagttcgtaggacctaaaccgacccggtccccttacccgtcgaaccctacttaccgttcgtacgggtacccttaccccgtaaccgtcgggaaaccgggtaccggtacgggtaccttacgtaacctttaacgttttaacgttacgtacctacggtaccttacgtaacgttaaacttaaccgtaaaggtaccccgtaaggtacccggtttacctaaccggggttttaggggtttaccgggttaccgggggaccggggttaccgggggtaccccggtacccggtttaccgggtaacccggttttacccgggtttaacggtaccggttaacccggacccccgggtaaacggtccccggtacccgtttccccccccgggtacgggttaccccttaacccgg

SEQ ID NO: 60757 - DNA, 534 bp, Homo sapiens
  misc_feature: GYAE6OF02G3V0H.37.74.G08.1.454.CMB.1.raw
  modified_base (223)..(223): a, c, t, g, unknown or other
  misc_feature (223)..(223): n is a, c, g, or t
  modified_base (310)..(310): a, c, t, g, unknown or other
  misc_feature (310)..(310): n is a, c, g, or t
  modified_base (332)..(332): a, c, t, g, unknown or other
  misc_feature (332)..(332): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttataaatatgtctcttggtaccaacatcaaccaacatcacccaggcaaagtccccaaactcataatttangaggtacactaaacggccctanaggtagtttactaatcgcttctctggctcaagtctggcaacgcggccctcctgaccatctcgtgggcctccaactggacgacgaggctcacttattatcgcagctacatatacagcagtcgtactgttgggtcgttcgggacggtaacgggacctacgtcgaccgttgttacggtccacgacccgaaggtcctcgtcccccg

SEQ ID NO: 60758 - DNA, 573 bp, Homo sapiens
  misc_feature: GYAE6OF02GIXMQ.37.74.G08.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (470)..(470): a, c, t, g, unknown or other
  misc_feature (470)..(470): n is a, c, g, or t
tcagtagtgtagatcacgaccggtgctcgatttagtagctctatcaggggggggtctcaagggacggacagccgctcgtcaggaccatctccaccatggccctgggcctctggcgtgctcctcaccctccttcactcagggcacagggtcctagggcccagtcctgcccctggactcagcctgcctccgtgtctgggtctcctggacngtcgatccaccgatctcctgcacgtcggaacccgnagtgacgttggtgttataactatgtctcttggtaccaanatcaccaggacaacgtccccaaatcatgatttagtgaggtcacgtaaacgccctacgacgggtctactaatcgtcttctctggactactaagtcgtcggacaacgcggccctcctgacccatccgtacgtcggcctaccgaggtcctggaccgacggtacggctacacttaagttagtcgccagcctnatagtacaacgcgagactatctacggttgggtcgtcggcggaggtaccgtctcggtaccgtcgttacgtcacgacccgaaggtctcccgtcccgtggtacccg

SEQ ID NO: 60759 - DNA, 611 bp, Homo sapiens
  misc_feature: GYAE6OF02GTRLN.37.74.G08.1.454.CMB.1.raw
  modified_base (320)..(320): a, c, t, g, unknown or other
  misc_feature (320)..(320): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttaataaatatgtctcttggtaaccaacatccaaccaaactctccaacccaggaccaaacgtccccaaactcaataatttangagtacaacgtaaaccggccctagaggtatttactaatcgtcttctctggcctacctaagtctaggaccaaaccgaccggtccctccctacgaccctactccttacgtcgggtcctacccaaccgtggaacggacggacggtctaccacttattattcgcagtctacatacgtaacaacgcaacgtccgtacgtacgttgggttacggtcgggtacgggacgggtaaccgtccgtacggtacccgttcgttacggtcgtaccggacccggaacggtccgtcccgtccccgg

SEQ ID NO: 60760 - DNA, 594 bp, Homo sapiens
  misc_feature: GYAE6OF02GR32R.37.74.G08.1.454.CMB.1.raw
  modified_base (299)..(299): a, c, t, g, unknown or other
  misc_feature (299)..(299): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggacaaagtccccaaactcatgatttangagtcactaaacggccctcgagggtctactaatccgtacttctctggctcaagtctggactaacgacgccctcccgtcgaccatcctacgtcgggtcctccgacgggtctaggaccgacggaacggcctacgaacttattagttcgcacgcctactaattacgaacaagcagacctaatccgtaacgtttggggttcgttaccggggacgggtaacgggtacccgtaaccgtcggtacccggttacggttacggtacgacggacccgtaacggccgttcccgcccccgttaccgg

SEQ ID NO: 60761 - DNA, 566 bp, Homo sapiens
  misc_feature: GYAE6OF02GCEUI.37.74.G08.1.454.CMB.1.raw
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
tcagtagtgtagatcacgaccggtgctcgatttagtagctctatcaggggggggggtctcaggaggcagcgctctcaggacatctccaccatggcctgggctctgctgctcctcaccctactcactcagggcacagggtcctgggcccagtctgccctgactcagcctgcctccgtgtctgggtctcctggacagtcgatcaccatcctcctgcactggaaccagcagtgacgttggtagttataaatatgtctcttggtaccaacatcaccaacatcacccaggcaaacgtccccaaatcataatttangagtcaactaaacggccctnaggtagtttctaatcgtcttctctggctccaagttctggacaacaccggcctccctgaccatctctgggcctccaactgacggacgaggctcacttattatgcagtctctaatactaacaagcagtccgtactacgttggggttagttcgggacgggaacgggaacccgtaccgtacggtaccggttacgttacgggtccgaaccggacccgaacggtcctaccggtaccccccgg

SEQ ID NO: 60762 - DNA, 688 bp, Homo sapiens
  misc_feature: GYAE6OF02HKB7I.37.74.G08.1.454.CMB.1.raw
  modified_base (225)..(225): a, c, t, g, unknown or other
  misc_feature (225)..(225): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatccaccatctccgtgcacgtggaaccngcagtgacgttggtagttaataatatgtcttcttcggtaaccaactactacaaccaacactaccaccctaggacctaaacgtaccccaaactcaattaactttagagtagtacaaccgtaaaccggccctacgaggtacgtttactaatcgtacttctcgtcggtactaccgtaagtccgtacggaaccaaccgtccgggtacccttaccccgtacgtaacctacgttccgtcgtcggggtacctaccggaacgtacgtacggacgggtacggacggtcttaggtaactttacgtacgtcgtacgttacgttactaagtagtaacggacgtaccgtaccgtaaccgttacgttacttcggttaccgttacgggtaacggtaccgggtaaccgtacgggttaccgttaccgtacgttaacggtaccgaaccggtaccccggaaccggacccctaaccccgtacg

SEQ ID NO: 60763 - DNA, 699 bp, Homo sapiens
  misc_feature: GYAE6OF02GCH5E.37.74.G08.1.454.CMB.1.raw
  modified_base (283)..(283): a, c, t, g, unknown or other
  misc_feature (283)..(283): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgccactcggaaccagcaggtcgacggtttggtaggttaataaatatgttctcttggtaccaacatcaccaanactcacccaggacaaacgtccccaaactcaattaattatagaggtacaactaaaccggccctacgaggtacttttactaactccgtacttcctacgtcggtcttaccaagttcgtacggacctaaccgacccgggtcccttcccgtacgaacccctattccgttccggtacgggacccttacccgaaaccgttgggaaccggaacggtacggtccgtaactacttaatttaacgttgacctacgtaccttagaattaaccgtaacgaacgtccgaacggtcccgttacgtacggtttggggttaccgggttcggggaccgggtaccgggtaaccccggtaccggttacggacccgttttaggttaccggtaccgtaacccggcccgtaacgggtcccttacccggttaccccccgg

SEQ ID NO: 60764 - DNA, 674 bp, Homo sapiens
  misc_feature: GYAE6OF02H8OM7.37.74.G08.1.454.CMB.1.raw
  modified_base (224)..(224): a, c, t, g, unknown or other
  misc_feature (224)..(224): n is a, c, g, or t
  modified_base (321)..(321): a, c, t, g, unknown or other
  misc_feature (321)..(321): n is a, c, g, or t
tcagtagtgtagatcacgaccggtgctcgatttagtagctctatcaggggggggggtctcaggaggcagcgctctcaggacatctccaccatggcctgggctctgctgctcctcaccctctcactcagggcacagggtcctgggcccagtctgccctgactcagcctgcctccgtgtctgggtctccgtggacagtcgatcaccatctcctgcacgtggaaccngcagtcgacgttggtagttaataatatgtcttcttacggtaccaacatacaaccaacataccaccacggacaacgtaccccaaactcaataatttangtagtacaacgtaaacgcctacgacggtagtttactaacttcgtacttctctggtctacctaggtactacggtaccaaccgacgggtccccttccctacggacctacttccgttcgtacgggtccttaccaacccgtaggtaacggacggtacggtactacctacttaatttacgtcgactacgtactacacttacgtaactaacgtactacgtcggtacgttaacggttcgggttacgggtaccgggtacggggaccgggtaacccggaccgttaccgggtaacccggtttacggttacggtacgaacccggttacccggaaccgggttcccgtacccggttaccccccggg

SEQ ID NO: 60765 - DNA, 692 bp, Homo sapiens
  misc_feature: GYAE6OF02IJMWF.37.74.G08.1.454.CMB.1.raw
  modified_base (596)..(596): a, c, t, g, unknown or other
  misc_feature (596)..(596): n is a, c, g, or t
tcagtagtgtagatcacgaccggtgctcgatttagtagctctatcgaggggggggggtctcaggaggcagcgctctcaggacatctccaccatggcctgggctctgctgctcctcaccctctcactcagggcacagggtcctgggcccagtctcgccctgactcagcctgccctccgtgtcgtgggtcctccgtaggacaggtcgatccaccatcctcctgactacgtaggaaccaggtcaaggttgtacggtttgggtaggttaaataaatgtgtctcgttaggtaaccaactatccaaccaacactaccaacccgaggacaaaaccgttccccaaaactctaattaatttagaggtaacggtaccaaacgtaaacccgggcccttagaaggttacgtttaacctaagtccgttacttcgtcgtacggcctaacgtaacgtcgtacggacaaaccgtcggtccctacccgtagacctacgtcgtcgtcgggtccttaccgtaaaccggtggaaaccggacgagggtccctaacgttaccttaagtttacgtcgactacgaccttacaataactaagacgtcgacgtcgttaacgngtttacgggtctacggggacggtaaccgggacctaccgtacggtaccgttacggttacgcggtaaccgcccggtaactccgtacccggtcccccgg

SEQ ID NO: 60766 - DNA, 542 bp, Homo sapiens
  misc_feature: GYAE6OF02IOKJV.37.74.G08.1.454.CMB.1.raw
  modified_base (221)..(221): a, c, t, g, unknown or other
  misc_feature (221)..(221): n is a, c, g, or t
  modified_base (459)..(459): a, c, t, g, unknown or other
  misc_feature (459)..(459): n is a, c, g, or t
tcagtagtgtagatcacgaccggtgctcgatttagtagctctatcaggggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcatcaccatctcctgcactggaaccngcagtgacgttggtggttaataaatatgtctcttggtaccaacatcaccaacatcacccaggacaaacgtccccaaaactccaataatttatagaggtacaactaaacggccctacgaggggtctactaatcgtcttactctggctcaagtctggacacacggccctcctcgaccactctcgtgggcctccgaggtctcggacgacggacgtctcacttatactgcagtctacattanacagacagacatacagttgggtcggttcggacgggagggaacccgtacgtacgaccgtcgttacgctacgaccgaacgtcccg

SEQ ID NO: 60767 - DNA, 603 bp, Homo sapiens
  misc_feature: GYAE6OF02GF2NZ.37.74.G08.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttaataaatntgtctcttggtaaccaacatcaccaanatccaccaggacaaacgtaccccaaactcaataatttangagtacaacgtaacgcctagagtagtttactaatcgtcttctcgtgctacgaagtcgtggacctaacgaccggtcctcccgtacgacctatcctcgtcggctaccacgtggacggacgacggtctactacttattactcgacacgtctacataactaacgaacgtcgaacggtacttacgtacgtttcggggtcgttaccggggacgggtacgggacccgtaccggtccgtaccgttacggttacggacctaccggacccggtaagggtcccgtccggtaccccccgg

SEQ ID NO: 60768 - DNA, 686 bp, Homo sapiens
  misc_feature: GYAE6OF02IIA10.37.74.G08.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacgagggtcctgggcccagtcctgccctgactcagcctgcctcgtgtctgggtcctccgtggacagtccgatcaccatctccngcactggaaccngcagtgtacgttggtgttaataatagtgtctgttggtaccaacactcaccaacataccaccaggaccaaacggtaccccaaactccaattaactttactgtacgtaccaacgtaaccggtccctacgaggtacgtttacgtacgtcgtactttcctcgttggccttaccgtaacgtccaggtacctaaccgaccgggtcccttcccgtacgaccctactcctccggtcgggtacctaccaccggtgacggaccggagtcctacacgtttattacgtgacctagccttacattaccgtaaacacgtaccgaacgtccggttacttaccgggttagggttcggttccgggacgggaacggggttacccggaacccgttaccggggtaccccgtttacgggttacgggttcccgtaaccggtacccggtaaaccggggtccgttccccggttaccccccggg

SEQ ID NO: 60769 - DNA, 658 bp, Homo sapiens
  misc_feature: GYAE6OF02GG7IX.37.74.G08.1.454.CMB.1.raw
  modified_base (228)..(228): a, c, t, g, unknown or other
  misc_feature (228)..(228): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacgagggtcctgggcccagtctgccctgactcagcctgcctccgtgtctgggtctcgtggactagtcgatcaccatcctcctgcacgtcggaaccngcaggtgacggtttggtagttaataatatgttcttcttaggtaaccaactatacaaccaacactacacccaggacaaaccgtaccccaaactactaattaatttataacggacgtaacctaaccgtaaaccggtccctacgtaggtaacgtttacgtaagtccgtccttctacgtcggtctaccgaacgttcgtacggtaccaacgtacccggcccttcctacgacctactcctacgtcgggtcctaccgtaacctaggacgggaccggtacgtccgttactaaccgtttattagttacgctaacgtcttataatactaaactagacgtacgtctacgtacgttcgggtgtacggtacgggtacgggacctaccggtacgaccgttacggttacggtaccgtaccggacctacggtcctccggtaccccg

SEQ ID NO: 60770 - DNA, 692 bp, Homo sapiens
  misc_feature: GYAE6OF02GBCMQ.37.74.G08.1.454.CMB.1.raw
  modified_base (194)..(194): a, c, t, g, unknown or other
  misc_feature (194)..(194): n is a, c, g, or t
  modified_base (232)..(232): a, c, t, g, unknown or other
  misc_feature (232)..(232): n is a, c, g, or t
  modified_base (349)..(349): a, c, t, g, unknown or other
  misc_feature (349)..(349): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacnggtcgatccaccatcctcctgaccacgtacgggaaccngtcaggtgtaccggttggtagttaataaatagtgtcttcgttacggtaaccaacactaccaaccgaacactacccacccgaggacctaaaccgtaccccaaactctaattaatttanacggtacgtaccgtaaccgtaaaccgccctacggtacggtacgtttactacgtcgtctttctcgtcggtacctaccgtacgttcgtcggaccaaccgacccggtccctacccgtagaacctacgttccgtcggtacgggtccctaccggaggtcgtaggacggtacggacgtactagttacttacttacgcggtctcgtacttacgtaattgacgtacggtaacggtcttactaccttctttacgttcgttaccggtaacggtaccggttccgggtaaacctaccgggttacctaaccccggttactaacgtacccgacggtaccccggtaccgtaacccccg

SEQ ID NO: 60771 - DNA, 754 bp, Homo sapiens
  misc_feature: GYAE6OF02HQ323.37.74.G08.1.454.CMB.1.raw
  modified_base (225)..(225): a, c, t, g, unknown or other
  misc_feature (225)..(225): n is a, c, g, or t
tcagtagtgtagatcacgaccggtgctcgatttagtagctctatcgaggggggggggtctcaggaggcagcgctctcaggacatctccaccatggcctgggctctgctgctcctcaccctcctcactcagggcacgagggtcctgggcccagtctcgccctgactcagcctcgcctccgtgtctgggtcctctggacagtcgatcacatctctgcactcggaacngctagtgtacgttggtaggttaataattagtcgttacgttcgttacggtaaccaacgtactacaaccaacactacccacccgaacggtaaccaaaccgttaacccccaaaacgtcctaaatttaactttagtacggtaacgtaccaaaccgttaaaccggtacccctacgtaacggttacgtttaccttaaacttccgttccttacttacggttcgtaccttaccgtaagttcgttacggaaccaaccgtaccgggtcccttccgtacaacctacttccgtcgaccggtctacccgaacgtcggacggacgtacggtcctacgtaactttattacgtacgtaccagtacctactaacgtaacctaacgaacgtacgtaaccggttactaccggtttacgggtttcgggttcgggttaaccggggtacggggaacccgggttaaccccgttacggtaaccgggttacccgtacggttacggtaccgtaccggtaaccccggtacggtcccggttacccggttacccccgg

SEQ ID NO: 60772 - DNA, 927 bp, Homo sapiens
  misc_feature: GYAE6OF02JWHCJ.37.74.G08.1.454.CMB.1.raw
  modified_base (160)..(160): a, c, t, g, unknown or other
  misc_feature (160)..(160): n is a, c, g, or t
  modified_base (396)..(396): a, c, t, g, unknown or other
  misc_feature (396)..(396): n is a, c, g, or t
tcagtagtgtagatcacgaccggtgctcgatttagtagctctatcaggggggggggtctcgaggaggcagcgctctcaggacatctccaccatggcctgggctctgctgctcctcaccctctcactcgagggcacgtggggtccctgggaccctagtccncgcccgtagacctcacgtcctcgcccgttacggtcgtccggtggggtcccttccggtagggaactacggttccggacttacccaacgtccttaccgtccggtcgtaaccgtaccggtaaacggaacccggctacggtaaggttccgggttaggggttagggtttaagttaaaattaacttggttcgttacgttacggtacgtaaaccactactccaaacactacgacccacggaanaaaccgtaccctaaccgtaactattaaactttattacggaggtaaccaaccgtaaacccggttaccgccgtacggtaacgttttacggtaactcggtacctttccttaccgtacggtcccgtacgttaacctacgggttaccgaccgtaaacgaacccgggttccccgtccttaacccggtaccgtaccgtttacccgttccggttaaccgggtcccgtaccggttaacggtaccgggttacgtaacccgggaaccggtaaccgggttaccggttaccctaacggttaaacctttaggtttaccggtaaccgtacgaacgttacgtaacgtaaacgtttaccgtaaacggaccgtttaaagcccttaaaccggtaacgtttaccggttacggggtttacggggtttacccggggaaccgggggggttaacccggtaccgggtaaccccggttacccggttacgggtttaacccggtttccggttaaccggttaaccccggaccgggttaaccccgggtaggttacccccgg

SEQ ID NO: 60773 - DNA, 684 bp, Homo sapiens
  misc_feature: GYAE6OF02IF04X.37.74.G08.1.454.CMB.1.raw
  modified_base (232)..(232): a, c, t, g, unknown or other
  misc_feature (232)..(232): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
  modified_base (560)..(560): a, c, t, g, unknown or other
  misc_feature (560)..(560): n is a, c, g, or t
  modified_base (590)..(590): a, c, t, g, unknown or other
  misc_feature (590)..(590): n is a, c, g, or t
tcagtagtgtagatcacgaccggtgctcgatttagtagctctatcaggggggggggtctcaggaggcagcgctctcaggacatcctccaccatggcctggctctgctgctctcaccctcctcactcagggcacgagggtcctcgggcccagtctgccctgactcagcctgcctccgtgtctgggtcctccgtggacagtcgactcaccatcctcctgccacgtacggaaccngctagtgtacggttggtagttaataatattcgttcgttcgttacggtaacccaactactccaaccaaccactacccaacccgaacgggaacctaaaccgtacccctaaactcgtaaactttaatttaacgtcggtaaccggtacctaaaccgtaaacccggtcccctacgtaaggtacctttacgtaacgtccgtactttcccgtctacggtacccttacgtaacgtcgttacggaaccaaccgtaccggccctacccgtanacccgtntctccggttacggacccttacccgacgtacggacggtacgacggtctactagttacttntccgtcacgtctaactatactaagaccgtnaacggtctcgtaggttcggtcgtacgggacgggtacggccgtactcggtacgtacggtacgactaccggaccgacggtcccgtaccgtccccgg

SEQ ID NO: 60774 - DNA, 694 bp, Homo sapiens
  misc_feature: GYAE6OF02FZVJC.37.74.G08.1.454.CMB.1.raw
  modified_base (230)..(230): a, c, t, g, unknown or other
  misc_feature (230)..(230): n is a, c, g, or t
  modified_base (294)..(294): a, c, t, g, unknown or other
  misc_feature (294)..(294): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcgagggcacagggtcctgggccagtctgccctgactcagcctgcctccggtgtcgtgggtcctcctggacagtcgatccaccatctcctgctacgtcggaaccngacgaggtgtacggttggtagttaataaatatgtcttcttacggtacctaacactccaaccaanactccaccgaggaccaaccgtaccccaaactcaattaatttagtgtacgtacaaccgtaaaccggtcctacgaaggttacgtttactaacgttcgtactttcctacgtcggtacctaccgtagtacgtcgggaccaaccgaccggtcccctacctaccgacctacgttccgtccgttacgggacccctaacccgtaccgtcgggaaccggtacggcgtacctacgtactttaacttcgttacgacctagtcctataagttaactaccgaaatccgaactccggtagttacggttgggttacggtcggggaccggtaacggggacccgtacggtaccggtacccgtttaggttaccggtacgaacccggtcccgaacggtcccgttcccggtacccccggg

SEQ ID NO: 60775 - DNA, 756 bp, Homo sapiens
  misc_feature: GYAE6OF02HH0TJ.37.74.G08.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
  modified_base (324)..(324): a, c, t, g, unknown or other
  misc_feature (324)..(324): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacgagggtcctgggcccagtctgccctgactcagcctgcctccgtgtcgtgggtcctccgtggacagtcgatcaccntctctgcacgtggaaccngctagtgtacgttggtagttaataaatatgtcttcttaggtaccaanactcaaccaacactccaccaggacaaaccgtccccaaactcaattaattanagacggtactaacgtaaaccgtcctacgaggtacttactaacgtcgtcttctcgtacggtcctaccgtaagtcgtacggaccaaaccgtacccgggtcccttacccgtacgaccctagttcccgttaccggtcgggtacccttacccggtaaaccgttcgggaaccgggtaaccggacggttaccttacccgtaacttttaacgtttacgtttaccggaccgttaacggtccttacgttaaacttaaccgtaacgtaacggtacccgtaacggacccgtttaaccgttaccgggttttcgggggttacgggttacccgggggaacccgggtacccgggggtaacccgtaccgttaccgggtaacccgtttacggttaaccgggtccaaccggtaccccggtaacggtcccgttccccggttaaccccccggg

SEQ ID NO: 60776 - DNA, 582 bp, Homo sapiens
  misc_feature: GYAE6OF02FP2YY.37.74.G08.1.454.CMB.1.raw
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtgacggttggtaggttaataaatatgttctcttggtaaccaacatcaccaacactaccacccaggaccaaacgtccccaaatcaataatttangacggtacaacgtaaacgccctanaggtactttacaagtctcttctctggctcagtctgacaacgcgtccctcctcgacactctcgtcggctccacgtgacggacgaggtctacgtacttattacttgctacgtctacgtatacgtaacacgcagtccgtactacggtttgggttcgtcgggaccgggacgggtacccgtaccgtcggtacccggttgttacggtacgaaccggtccgaacggtccgtcccgtacccccgg

SEQ ID NO: 60777 - DNA, 819 bp, Homo sapiens
  misc_feature: GYAE6OF02F7LXK.37.74.G08.1.454.CMB.1.raw
  modified_base (128)..(128): a, c, t, g, unknown or other
  misc_feature (128)..(128): n is a, c, g, or t
  modified_base (252)..(252): a, c, t, g, unknown or other
  misc_feature (252)..(252): n is a, c, g, or t
  modified_base (386)..(386): a, c, t, g, unknown or other
  misc_feature (386)..(386): n is a, c, g, or t
tcagtagtgtagatcacgaccggtgctcgatttagtagctctatcgagggggggggtctcaggaggcagccgctctacaggacatcctccgaccagtggcctgggctctgctgctcctcgaccctccncactcagggccacgagggttcctgggccctagtcgtgaccctgacctcagcctgccctcggtgtcgtcgggtctccgtggacacgtcgactcgaccagtcctacgtgacgacgttcggaaaccngcgagtcgtacggttggtaggttaataatcgtcgttctcgttacggtaaccaacgtactaccaacctaactacgtacccaacccgagggacctaaaaccggtaccccctaaacgttcaaacgttaagttttacncggtaacggtaccctaaaccgtaaacccggcctacgtagggttaactttcgtaacgtctctttacgtcgtcggtcctacgtaacgtcgtacggtaccaacgtacccggtcccttaccgtacggtaaccctacgtttcccgttaccggtaccgggttacccttaacccgtaaccggtacgggtaacgggtaaccggttaccgggttacctttaacggttaacctttaagtttacccgtacggtacctaacggttactaaccgtaacttaccgtaaacgtaacggtacccgttaacggtacccgtttaccgtaacggggttttacgggaccggtttacccggggacggggtaaccggtaacccggtaccggtacgttacccggttaggtaccggtaccgtacggaccccgtacggtcccgtccccggttaccccg

SEQ ID NO: 60778 - DNA, 557 bp, Homo sapiens
  misc_feature: GYAE6OF02GKJSR.37.74.G08.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (332)..(332): a, c, t, g, unknown or other
  misc_feature (332)..(332): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
  modified_base (473)..(473): a, c, t, g, unknown or other
  misc_feature (473)..(473): n is a, c, g, or t
tcagtagtgtagatcacgaccggtgctcgatttagtagctctatcaggggggggggtctcaggaggcagcgctctcaggacatctccaccatgacctgggctctgctgctcctcaccctcctcactcagggcacgagggtcctgggcccagtctgccctgactcagcctgcctcgtgtctgggtctccgtggacngtcgatccactntctcngcactggaccngctagtgtagttggtagttaataatatgttctcgttacggtaaccaanactccaacaacactaccaacccgaggaccaaaccgtaccccaaacttcaagttaatttagngtacgtacaacgtaaccgccctagaggttacttactatcgtcttcctgtacgctacagtcgngacacgccgactccngactactcngtcgctccacgngtacggcgagctacactattntgctgctanactacacgagtcncgtctacgttcgttggtacgtcgggcgggacgaccgtcgtaggtaccgttgtacgtcgacggaccgagtacccgccggtacccg

SEQ ID NO: 60779 - DNA, 790 bp, Homo sapiens
  misc_feature: GYAE6OF02GM1U0.37.74.G08.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcacatcnctgcactgaaccngcagtgtacgttggtggttataatagtgtctcgttgtaaccatatcaccacatccaccaggaccaaacgtaccccaaactcaattaatttagagtacggtacaacgtaaaccggccctagacggtactttactaagtccgtactttccgtacgttcgacttaccgtaagttaccggtacggaacctaaacggacccgggttcccctacccgtacgtaaccctaagttccccgttaccggtacgggtacccttaaccccgtaaaccggttacgggaaaccgggttaaccggtacgggtacccttaacccgttaacggttttaacttttaacgttcccggggtacttaaaccgggtaccttaacccttaaagttaaaccgttaaccggtaaacgtcccgggttaaacgtcccggttaacgttaacccgggttttgggggttaacccggtttcggggggtaccggggtaaccggggtaacccgggtacccgttaaccgggtaccccggtttacgggttacggtacccggtaccggtaaccccggtacggttaccccggtcccggttaacccccggg

SEQ ID NO: 60780 - DNA, 630 bp, Homo sapiens
  misc_feature: GYAE6OF02HPB1Z.37.74.G08.1.454.CMB.1.raw
  modified_base (286)..(286): a, c, t, g, unknown or other
  misc_feature (286)..(286): n is a, c, g, or t
  modified_base (327)..(327): a, c, t, g, unknown or other
  misc_feature (327)..(327): n is a, c, g, or t
  modified_base (618)..(618): a, c, t, g, unknown or other
  misc_feature (618)..(618): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtcgtgggtctccgtggacagtcgactccaccatcctcctgcactcggaaccagcagtgtacgttggtagttaataatatgtcttcgttcgtaaccaatactaccaaccanactaccaccaggaccaaacgtaccccaactcaattatttanagtagtacaacgtaaccgcctagacgttacttactaacgtcgtcttctcgtacggtacctacgtagtcgtacggaccaaaccgtccggtccctccgtactaccgtactcctacggtccggtcctaaccgtaccgttggaaccggtacgaggtacctacgtacttattagtcgcgtatcgtactaataactgaaccgtcgtacgtcgtcgtagttgggtcgtacgggacgggtaaccggacccggtacctacgggtccgttacgttacggtccgaccggtaccgtcgtaccncccggttacccg

SEQ ID NO: 60781 - DNA, 746 bp, Homo sapiens
  misc_feature: GYAE6OF02IPTSD.37.74.G08.1.454.CMB.1.raw
  modified_base (257)..(257): a, c, t, g, unknown or other
  misc_feature (257)..(257): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatccaccatctcctgcacgtcggaaccagactagtgtacggttggtggttaataaagtntgtctcgttacggtaccaacgtactcaacctaactactaccgacccgaaggacctaaaccggttacccccaaagtacctaaatttaaactttacgtacggtaacggtacctaaaccgttaaaccgggccccttaagtaacgggttacgttttacctaacgtccggttactttccgtacgttacggtacttaccgtaaagttccgtacggaacctaaaccggtccggtacccttaccgtacgaacccttaacgttccgtacggtacggacccttacccgtaacgtagggaaccggtacgacggttaccttacgtaacgtttacgtttacgtcgaccgtagtaccttacgtaagtactaacgaacggtccaagtacctaacgttcgttaaccggtttcgggtacggtcgggaaccgggtacgggtaccgtaccgtacggttaccggttacggttacggaccgtaccggtaccgtaccggtccggtaccccg

SEQ ID NO: 60782 - DNA, 663 bp, Homo sapiens
  misc_feature: GYAE6OF02G0YMM.37.74.G08.1.454.CMB.1.raw
  modified_base (194)..(194): a, c, t, g, unknown or other
  misc_feature (194)..(194): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacngtcgatcaccatctcctgcactggaaccagcagtgacgttgtagttanaatatgtctnttgaccaantcacanatcaccagcaacgtcccaaactcataattangagtcaactaacggcctagaggtagttactaatcgtacttctctaggcctaccaagttccgtggacaaaccgacccggtcccttaccctaggtaacccctattccttaccggtcgggtccctaacccgaacccgtgggaacgggaccgtaaggtcccttaccgtaaaccgtttagtttaacgttcggactaacgttccgttaacctaattaaccgtaacgtaacgcgtaaaccggtcggttaaccttacggttcggggttccggtttaccggggacggggtaaccgggtacccgaaccggtcgtacccgggtttactacgggttacccgacgtaccccggtaagggcccttccggtaccccccgg

SEQ ID NO: 60783 - DNA, 766 bp, Homo sapiens
  misc_feature: GYAE6OF02JRHJY.37.74.G08.1.454.CMB.1.raw
  modified_base (171)..(171): a, c, t, g, unknown or other
  misc_feature (171)..(171): n is a, c, g, or t
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (458)..(458): a, c, t, g, unknown or other
  misc_feature (458)..(458): n is a, c, g, or t
  modified_base (512)..(512): a, c, t, g, unknown or other
  misc_feature (512)..(512): n is a, c, g, or t
  modified_base (693)..(693): a, c, t, g, unknown or other
  misc_feature (693)..(693): n is a, c, g, or t
tcagtagtgtagatcacgaccggtgctcgatttagtagctctatcgagggggggggtcgtcgaggaggcagcgctctcaggacatctccaccatggcctgggctctgctgctcctcaccctcctcactcgagggcacgagggtcctcgggccaggtctcgccctagactcncgcctcgcctcgtgtctgggtcctcgtcgganacgtcgactccacctactctcccgngtaccacgtacggaaccngactacgggtggtacggttggttagttaaataaagttattgtcttcgtacggtaaccaaaccgtacactaaccaaagactacccgaacccgtaggtaaccaaacccgtaccctaacctagtaaactttacgtttaacaggtaccgacgttaaccgaaacccggtccgtcgtaaacgggttactttacgtaaacttccgttaccttccggttntcggaccccttaattacggtaccgtacggaactaaccccgaccgggttaccccnccgtaaccgcctaacgtccgttccggaccggttacctacccgaacgtacggaaccgggtcggagtcctagtaccttaatttcgtacacttcgacttacgtacttaaacgtaccgaacttcgaaccgtacgttaaccgttacggttcgggtaccggtcgggaacgggtaaccgggtacccgngggttaacccggttacggtaccggttaccggtacggaccctaccggggaacttccccgtaccgggtaccccgg

SEQ ID NO: 60784 - DNA, 782 bp, Homo sapiens
  misc_feature: GYAE6OF02IUYE2.37.74.G08.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacgacgggtcctgggcccagtcctgccctgacctcagcctgcctcgtgtctgggtctcctggacagtcatcaccntctcctgcactggaaccngcagtgacggttgtagtataatagtntctcttcggtaaccaacactccaaccaacactaccacccgaggacaacgtacccaaactctataattanacgtacggtccaactaaccggcctacgtaggtacgtttactaacgtaccgtcttcctacgtcgtacctacgaacgtcgtacggtaccaccgtaccgcccttacccgtacgaccctacgttccgtcggtccggtaccctaccggtaacccgttagggaaccgggtaaccgtacggtaccttaccttaaccttaacgttaacgtttccggaaccgttacgtacctttaaccgtaaactaaccgttaaacggtacccgtaccgtaacccgggttcccggtttaaccggtaaccggttttggggggttaccggtttaacccggggtaccgggggtaaccgggggttaacccccgtaaccgggttacccggttacccgggtttaccgggtttaacccgggtccccggtaaaccggggtacccccggtaacgggttacccccccgttccccgggttaacccccccggg

SEQ ID NO: 60785 - DNA, 668 bp, Homo sapiens
  misc_feature: GYAE6OF02GRJMV.37.74.G08.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
tcagtagtgtagatcacgaccggtgctcgatttagtagctctatcagggggggggtctcaggaggcagcgctcgtcaggacatctccaccatggcctgggctctgctgctcctcaccctctcactcagggcacagggtcctgggcccagtctgccctgactcagcctgcctcggtntctggtctcgtggacngtcgatcaccatcctcctgcctactcggaaccngcagtcgacggttggtagttaactaaatatcgttctcttggtaaccaanatcaccaacactcacccaggacaacgtacccgaactcattaatttatgagtactaacgtaaaccgtccctacgaggttacgtttacgtaactcgtcttacgtctcggtctaccgtaagtccgtcggaccaacgacccgggtccctacccgtctaccactaccgtcgttcgggaccgtacccgtaacccgtggaacgggtaccggaacggtccgttactaaacgttaagtttacgttcgacacggtaccttactacgttaacaacgtaaccggactaaggtcccttagtaccgtttggggttacggttaccgggcggggtaacgggacccgtacgtacggtaccgttcggttaacgtccgaccggcccggaacggtcccgtacccggtacccccg

SEQ ID NO: 60786 - DNA, 754 bp, Homo sapiens
  misc_feature: GYAE6OF02JRNX7.37.74.G08.1.454.CMB.1.raw
  modified_base (82)..(82): a, c, t, g, unknown or other
  misc_feature (82)..(82): n is a, c, g, or t
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (557)..(557): a, c, t, g, unknown or other
  misc_feature (557)..(557): n is a, c, g, or t
tcagtagtgtagatcacgaccggtgctcgatttagtagctctatcgagggggggggtctcaggaggcagcgctctcaggacntctccaccatggcctgggctctgctgctccgtcaccctcctcacgtcagggcacgagggtcctgggccagtctcgcctgactcagcctgacctcgtgtcgtgggtcctaccgtgactaggtcatccacgtntcctcgngacctagtcggaaacctgctaggttcgtacggtttgaagttaactaattgtcgttcgttcgttacggaacctaactactaccaaacctacgtaccaccgtaaacccgtggggaaccctaaaccgtaacccctaaacttacgtaaactttaagttcgtaacggtaacgttaccgtaaacgtaaccccggtcctacggtaacgggttactttaaccgtaacgtccgttcttccgtagtttccggaccttaacgtaaggtcgtacggacctaaccggtccgtccttaccacgtactactcgcgtcggtcctaacctagtacggacggacgtacgtacttntaaccgttattcgttcgactacggtactacgtaactaacgtacgaactcgtaaccggttacgttacggttaccgtttacggggttccggtaacgggtacccgggaaccgttaacccgggtaccgtaaccggttcggttaaccgttacggtaccgtaaacccggtccggtaaccggttcccgtaacccggttccccgg

SEQ ID NO: 60787 - DNA, 687 bp, Homo sapiens
  misc_feature: GYAE6OF02IOCD4.37.74.G08.1.454.CMB.1.raw
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacgacgggtcctgggcccagtctcgccctgacctcacgcctgccttccgtgttcgtcgggtcctccgtggactacggtcgtatccaacctattcctccgtgctacgtacggaaccagcagtcgtacggttggttagttaataaagttacgtgttcctcgttacggtaaccaactacgtaccaacaactactccaaccgacggaacctaaaccgtacccctaaactactaactttaaatttacgtacggtaacggtacctaaaccgtaaaccggtccttaacgtacggtactttactaacgttccgtacttctccgtcgtcctaccgtaagtcgtcgactaaccgccgccttcctacgactacgtctcgtccggtctaccaacgtggacggacgacgctactacgttnttntacgctacgactactactaatacaactcaacgtcgttaccgtaggttcgggttacggtaccgggacgggtacggacccgtacgttcggtaacccgttcggttaacggtccgaaccggacccggtagtcccgtcccggtaccccgg

SEQ ID NO: 60788 - DNA, 693 bp, Homo sapiens
  misc_feature: GYAE6OF02ICGS0.37.74.G08.1.454.CMB.1.raw
  modified_base (227)..(227): a, c, t, g, unknown or other
  misc_feature (227)..(227): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacgagggtcctgggcccagtctgccctgactcagcctgcctccgtgtcgtggtctccgtggacagtcgatcaccatctcctgacacgtggaaccngcagtgacgttgggtagttaataaatatgtcttcttaggaaccaacatacaacacgataccaccgaggactaaaccgtaccccaaatctaattacttagtagacgtacaacgtaaaccggcctacgaaggttactttactaacgttcgtacttctacgtcggtacctacgtaagttccgacgtacctaacgtaccggtccctccgtacgacctacttcgtacgtcgggaccttaccgaacgtcggaacggacgtacgtccttactaacttagttactacgactagtccctataactaacgtaacaacgtaccgacggttaccgtacgttaaccgggtttggggttacggttaccggggtaccggggtaaccgggaaccccgttacggtacccggttaccggtttaccgtttaacgggaccggtaaccggaccccggtaacgggtcccgttaccccggtacccccgg

SEQ ID NO: 60789 - DNA, 860 bp, Homo sapiens
  misc_feature: GYAE6OF02H9C71.37.74.G08.1.454.CMB.1.raw
  modified_base (141)..(141): a, c, t, g, unknown or other
  misc_feature (141)..(141): n is a, c, g, or t
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacacgggtcncgggcccagtcctcgccctgcctcagtccctgcctccgtgtcctgggtcctccgtaggacngtcgatccaacntcgtcctgactctaggaaccagcaaggtgtaattattacaaaacttactaaacgttctcgttacttcggttaaccaacacgacctaacccgaggaccgtaaaaccgaacccccaaactaccatagtaactttgtcgtaaggaccaagtaaacggcgcccgtagtacggggtttctaaatccggtactttcgtcgttggccttacctaaacgttcgcggacctaacgaacccgggtcccttaccccgtacgaacccgtcttttaaccgcccgttacgggccttaccccggttacgggacccgtttacggaaacccgggtaaacgggtaacccggaccttaaccgtaaccccgttttaaaatttgttaaccgtttacgaaccggtaccgttaacctaaaggttttaaacctaaacccggtaaaaaggcccgaaacgtaaaccgggttaacctaccgtttaaaccgggttttcgggttttaccggggttttaccggaaccgggggggtttaaaccccgggtaacccggaaccccggttttacgggtaacccccggtttaacccgggtttaggtaacccccgggtttacccggtaccccttaaaacccggggtcccttacccgggaccccccccgtttttaaccccgggg

SEQ ID NO: 60790 - DNA, 721 bp, Homo sapiens
  misc_feature: GYAE6OF02J0P9N.37.74.G08.1.454.CMB.1.raw
  modified_base (133)..(133): a, c, t, g, unknown or other
  misc_feature (133)..(133): n is a, c, g, or t
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcanagggtcctgggcccagtctgccctgactcagcctgcctccgtgtctgggtctcctggacagtcgatcaaccntctctgcnctaggaaccngcagtcgaggttgagttaacaaatntcgtntcgtgtaaccaantacacctacatccactaagactaaacgtaccccaatacgtattaatttacagtacgtacaaccgtaaacggtcccctagaacggttactttaacgtaacgttcgtactttccgttacgtcggtaacctaccgtaaagtttcgtacggaccgtaacccgtacgggcccctttacccgacgtaacccgtcttaccgtccgtcgggtacccttaacccgacgttacggtacggaacgtccgggtacctaccgaagtttaccttcgtacggtctaacggtacctactaaacgtaacctaccgtaagccgtaacgttacccgaacgttccggtacggggtttacgtccgggtaccggggtacggtaacccggtaccgtaaccgggttcccgttaacccggtagggtaccccgttaaccggaccccggttaacggtccccggttacccgttaaccccccgg

SEQ ID NO: 60791 - DNA, 653 bp, Homo sapiens
  misc_feature: GYAE6OF02FT1UW.37.74.G08.1.454.CMB.1.raw
  modified_base (223)..(223): a, c, t, g, unknown or other
  misc_feature (223)..(223): n is a, c, g, or t
tcagtagtgtagatcacgaccggtgctcgatttagtagctctatcagggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccntcagtgacgttggtagttaataaatatgtctcttggtaccaacactcacccaggcaaacgtccccaaactcatgtatttatgaggtacaactaacggcctcgagggtctacgtaatcgcttctcgtgcctcaagtcgtggacaacgacggtccctccgtcgacctatcctcgtacgggcctaccgacggtctaggaccgaacggacgcctacgtaacttagtttacgttcgcgacgtcctacgtaattaacgtaacctaagaccgacgtaccggttactaccgggtttgggttcggttaccggggacggggtaaccggggtacccggtaaccggtacgggttaaccccgggttacggttaaccgggtacccggtaccggtacccggtaaacgggtcccgttaccccggtcccccggttcgggtaaccccg

SEQ ID NO: 60792 - DNA, 711 bp, Homo sapiens
  misc_feature: GYAE6OF02FQ2JO.37.74.G08.1.454.CMB.1.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
tcagtagtgtagatcacgaccggtgctcgatttagtagctctatcaggggggggggtctcaggaggcagcgctctcaggacatctccaccatggcctgggctctgctgctcctcaccctctcactcaggacacagggtcctgggcccagtctgccctgactcagcctgcctccgtgtctgggtctctggacagtcgatcaccatctcctncactggaaccagcagtcgaattatagaacttataaccttgtctctagtaccaacngcaccaggacaaacgccccaaactcatcgtatttanaggtacgtactaacgtaaaccgtccctcgacgggtccttactaagtcctcgttctcgtggccttccaagttctagggaacctacgaccgtccctcctacgaccctacgttccgtacggtcggggtaccctccggtaacgggtcctacgggtaaaccggacgggtaacggtccttaactaaccgtttatttacgttcgacttacgtaccgttacgaattaacgtaaccgtaagaaccgacgttaccaacttaccgtaacggttttcgggggttacggtacccggggtaccggggtaacgggtaccccggtaaccggttaccggttaccccggttaccggtttaacgggttacccggaacccggttacccgggaaacgggtccccggttcccggtaccccccggttacccgg

SEQ ID NO: 60793 - DNA, 626 bp, Homo sapiens
  misc_feature: GYAE6OF02HA7H6.37.74.G08.1.454.CMB.1.raw
  modified_base (241)..(241): a, c, t, g, unknown or other
  misc_feature (241)..(241): n is a, c, g, or t
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
tcagtagtgtagatcacgaccggtgctcgatttagtagctctatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttanaaatatgtctcttggtaccaacatcaccaacatcacccaggcaaacgtccccaaactcataattangagtcactaaacggcctcaggntttctatcgcttctctgctcagtctggcacacggcctcctgaccatctctcgggaccttccaaccgttggaacggacgaggtcctacaactttattacgttcgactacggtccttacgtaattaacgttaaccaaggaccctaagggtcccgttacgtaacgggttttggggtcgggtttaccggggacggggtaaccgggggacccggttaccccgtggtaacccccggtttaggtttaacgggtcccgtaacggtaccccccggaaagggttccccgtacccggtcccccccggg

SEQ ID NO: 60794 - DNA, 736 bp, Homo sapiens
  misc_feature: GYAE6OF02ISYH8.37.74.G08.1.454.CMB.1.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (615)..(615): a, c, t, g, unknown or other
  misc_feature (615)..(615): n is a, c, g, or t
  modified_base (728)..(728): a, c, t, g, unknown or other
  misc_feature (728)..(728): n is a, c, g, or t
tcagtagtgtagatcacgaccggtgctcgatttagtagctctatcgaggggggggggtctcaggaggcagcgctctcaggacatctccaccatggcctgggctctgctgcctcctcaccctcctcacgtcaggaccacgacgggtcctcgggcccagtctcgccctagactcgacgcctcgcctcgtgtcgtggtctacgtggactgtcgactccacgtctcctccgtgactacgtacggaaccnggtccaggttanactaagtttacgtaaaattaccttacgttcgttcttacggttaccgtaacacgtcgaccgtaccccgaggaccctaaacccgaccccctaataccagttaccggttgtttacgacggaaggtaacgtaacggaccggtccgtccgttacgggtacggttactacgtcgctttcgacgtccgctaccgtaggtctcggaacacccgtccgtcctcacgtacgtagtctccggtcgtccgtcgacggttcgacgggacggttccgacgttacgattaacgtttacgtaccgtgtcccgtagcccgttaatccggtttagaccgggtcttaacgggttaccttacgttcctttaacggttntaccgtttaacccggtacggtaaccggttccggaaacgttaccggttccgttaaccggttaaccgtccggtaactccccggaacccggttaacccgtacccctaaccgggttnttacccgg

SEQ ID NO: 60795 - DNA, 398 bp, Homo sapiens
  misc_feature: GYAE6OF02GV9BB.37.74.G08.1.454.CMB.1.raw
  modified_base (122)..(122): a, c, t, g, unknown or other
  misc_feature (122)..(122): n is a, c, g, or t
  modified_base (127)..(127): a, c, t, g, unknown or other
  misc_feature (127)..(127): n is a, c, g, or t
  modified_base (134)..(134): a, c, t, g, unknown or other
  misc_feature (134)..(134): n is a, c, g, or t
  modified_base (138)..(138): a, c, t, g, unknown or other
  misc_feature (138)..(138): n is a, c, g, or t
  modified_base (151)..(152): a, c, t, g, unknown or other
  misc_feature (151)..(152): n is a, c, g, or t
  modified_base (154)..(154): a, c, t, g, unknown or other
  misc_feature (154)..(154): n is a, c, g, or t
  modified_base (156)..(156): a, c, t, g, unknown or other
  misc_feature (156)..(156): n is a, c, g, or t
  modified_base (162)..(162): a, c, t, g, unknown or other
  misc_feature (162)..(162): n is a, c, g, or t
  modified_base (166)..(166): a, c, t, g, unknown or other
  misc_feature (166)..(166): n is a, c, g, or t
  modified_base (178)..(178): a, c, t, g, unknown or other
  misc_feature (178)..(178): n is a, c, g, or t
  modified_base (186)..(187): a, c, t, g, unknown or other
  misc_feature (186)..(187): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagtagtgtagatcacgaccggtgctcgatttagtagctctatcaggggggggggtctcaggaggcagcgctctcaggacatctccaccatggcctgggctctgctgcctctcacctctcnctcgngtcacgngtcncggccagtctgcnncncnctctcnctcngtgtcgtcgtcncgagcgtnncnctctcncgcgcnacgacncngcgtgtgtgtatactagtactactntactctacactactcacncncgcacgactacaccgtcnctatatagtactacgacgaacgaactacgtccgtnacgtatntagtacgtntcgacgtacgtcgtactactgacgttactacgactctcgacnccgtcgtacnctactcgcctcgacacgtcgtaa

SEQ ID NO: 60796 - DNA, 619 bp, Homo sapiens
  misc_feature: GYAE6OF02FU5YL.37.74.G08.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (315)..(315): a, c, t, g, unknown or other
  misc_feature (315)..(315): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcagggcacgagggtcctgggcccagtctcgccctgacctcagcctgcctccgtgtctgggtctccgtggacngtcgatcaccatctcctgcctacgtcggaaccngcagtgtacgttggtagttaataaatntgtctcttaggaccaantacacatactcaccaggacaaacgcccaatcaataattancgagtcaactaacgcctacgagtacttacaatcgtcttctcgtagcctacgaacgtcgtacgacaaccgccgtaccttcccgtacgacctacttcgtcgtacggtacctacccgtaaccgtacgtacggacgtaacggtcctagtaacttattactgactacgtcctatacgtaactaacgactacgaaccgtctacgtacggttagggtacggttacgggaccgggtaacgggacctaccgtacggtacccgttacgttacggtaccgaaccggtacccggacggtaccgtacccggtccccg

SEQ ID NO: 60797 - DNA, 719 bp, Homo sapiens
  misc_feature: GYAE6OF02IBG7W.37.74.G08.1.454.CMB.1.raw
  modified_base (292)..(292): a, c, t, g, unknown or other
  misc_feature (292)..(292): n is a, c, g, or t
tcagtagtgtagatcacgaccggtgctcgatttagtagctctatcgagggggggggtctcgaggaggcagcgctctcaggacatctccaccatggcctgggctctgctgctcctcaccctctcactcgagggcacgtgggtcctgggcccagtctcgcctgactcgacgtcctgcctcgtgtcgtggtactcgagacagtcgatcgactgtctacgtcgactgacggactagcaggttgacggtttggtaagttaaataacgtagtcggtacttcgtacggttaaccaactntaccaacctaacggactccaacccgaagtaccgaaccgttaaccccaattacctaacgttaatttacgtgggtaactaaccgttaaagaaacccggtcgtacgtaacgggttaactttacctaaaggcctttaacgttcgtccgttcggtacctacggttacgtaccgtttacgggaacctaaaccggtcccgtcccggtttacccaaggtcccttagttcccgtaacgggtccgttacgacccttaacggtacgacgggtacgacggtactccttaacgttagttacgttcacgacgttcaccggttaactaacgtacgaaacgtcgtaaccggtctaaccgggtagtttaccgggtcggtacgggccggtaacggttaccggttaaccgacgttgtacgctcggtacgctaccggcgttaccccg

SEQ ID NO: 60798 - DNA, 865 bp, Homo sapiens
  misc_feature: GYAE6OF02HSJNV.37.74.G08.1.454.CMB.1.raw
  modified_base (619)..(619): a, c, t, g, unknown or other
  misc_feature (619)..(619): n is a, c, g, or t
tcagtagtgtagatcacgaccggtgctcgatttagtagctctatcgagggggggggtctcaggaggcagcgactctcaggacatctccaccatggcctgggctcgtgctgctcctcaccctcctcactcgagggcacgagggtccgtcgggacccacggtcctcggccctggacctacgacggcccgtcgcccttccggttcgtccgttcggggttcctccggtacggtacgtaacgttcgactaccacctacttcctccgtacgcctacgtaccggaaccgtcgtacggttcggtacggttcggtttaaggttaaacttaaaagtcgttcgttaccgttaccgtttacggtaaaccaactaacgtaccaacgtaaattacaacctaacccgtaacggaaccgtaaaacccggtacccctaaaaccttctaaacgtttaacgtttaacgtacggtaaacggtacctaaaccggtaaacgtacccgtaacgtacggtttaacgttactaacgtctaccgtttacgtaaccgtacgtaccgttaacgtaacgttcgtaaccaccggtaaactcccggttacctacccgtacgaccttaacgtccgtacgtccgggtaaccnccggttacggcgttacggaccgtccgggtactccgtaaccgttaacgttaaccggttctacggtcgtacgttccttaaaacgttcgtaacttaacgtacgtacttaaccggacttaacgttccgggtaacggtttcggggtaacggtaccggggttaacgggcccgggttaacccgtagttaacccgggtacttaccgggttacaccggtacccgggtaaaccgttccggtaccctttaccccggg

SEQ ID NO: 60799 - DNA, 792 bp, Homo sapiens
  misc_feature: GYAE6OF02G5O0C.37.74.G08.1.454.CMB.1.raw
  modified_base (251)..(251): a, c, t, g, unknown or other
  misc_feature (251)..(251): n is a, c, g, or t
tcagtagtgtagatcacgaccggtgctcgatttagtagctctatcgaggggggggggtctcaggaggcagcgctctcaggacatctccaccatggcctgggctctgctgctcctcaccctctcactcgagggcacgagggtcctcgggccctagtctcgccctgactcacgcctcgcctcgtgtcgtcgggtctccgtggactggtcgataccacctatcctcctgaccacgtacggaaccagcgtaggtntaattagttaacgtaaacctttaacttaacctttgttccttacgttacgaaccaacgacaccaaccgacggaaccaaacccgtacccccaactctacgttagtacgtttacggacggaacgtaacgtaacggtaaccgcccggtacccgttacgggttaaccggggtttaactacgttccggtcctttcgtcgtcggtacctaccggtaacgtcggtacgaacctaacccggtcccgtacccgttaccgtacgtaaccttactcccggttaccggtcgggtacccgtaccggtacggtacggtaacgggaaccgggtacggacggttacttaacggttaacgttttactaccgttcgtaccgttgtaccgttactaaggttcgttacgtacggttacgttaacgtacctttaactttaccggttacgtttaccgttaccgggtaccgttacgggaacggttaacccggttacgtacccgtaaccgtaccgttaacggacccgtaccgaaacccgaccgtaacccctaccggtacttacccg

SEQ ID NO: 60800 - DNA, 946 bp, Homo sapiens
  misc_feature: GYAE6OF02G4GKZ.37.74.G08.1.454.CMB.1.raw
  modified_base (697)..(697): a, c, t, g, unknown or other
  misc_feature (697)..(697): n is a, c, g, or t
tcagtagtgtagatcacgaccggtgctcgatttagtagctctatcgagggggggggtctcaggaggcagcgctctcaggacatctccaccatggcctgggctctgctgctcctcacctctcacgtcagggcacgaggtccgtcgggcccagtctcgccctgacctcagccgtgccctcgtgtcgtgggtcctcgtcggactacggctactccacctctcctcgtgaccacggtcggaaaccctaggctacgggtcggtacggttgggtacgttaaataaatcgttgtcttcggttacgtaaccacgtatacaaccaactactaccacccgaacggtaacctaaaccgtacccctaaattaacgtaaacgtttaactttaagtacgggaaacgttacccaaaacggttaacccggtacccgtaacgtaacgggttaactttacggtaaaaccttccgggtactttccgtacggtttacggacccggttaccgtaaacggggttcctacgggtaaacccgtaaaccggttaacccgggtttacccctttaccccggtaacgttaaacccgtcccgtttaaccgggtttacccgggtaccggggttaccctaaacccggtaaacccggttacgggaaaaccgggtaccgtacccggttaaacgttccccttaaaacgtttacgttttaccggtaaaccgngggttaccccaacggtttaaaacctaccgttaaaacgtttacggtaaacccggtaaaccgggttacccggttcggtaaaacccgttttcgggggttaaccgggtttccggggttaccggggggttaccgggaaacccggggttaacccttacccggggttcgttaaacccggggtttcccgtttaaaacgggcccgtaaaccccgggtaccgggtaaccggtccccgtttaaccccggttacccccggg

SEQ ID NO: 60801 - DNA, 751 bp, Homo sapiens
  misc_feature: GYAE6OF02HA2XM.37.74.G08.1.454.CMB.1.raw
  modified_base (168)..(168): a, c, t, g, unknown or other
  misc_feature (168)..(168): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (605)..(605): a, c, t, g, unknown or other
  misc_feature (605)..(605): n is a, c, g, or t
tcagtagtgtagatcacgaccggtgctcgatttagtagctctatcaggggggggggtctcaggaggcagcgctctcaggacatctccaccatggcctgggctctgctgctcctcaccctcctcactcgagggcacgagggtcctgggccctagtctcgccctgacctnacgtcctgcctccgtgtcgtcggtcctcctggacngtcgatccacctnttcctcctgacacgacggacctagctaggtgtacgttagggtagttaaactaattctcgtaccgttcgttaacgaacctaacgtacctaccaaccaactaccgtaacccaccggaacgaacctaaacccgtaaccccctaagttactaactttaaacgttggaacggtaccggaaccttaaaccgttaacccgggtcctacggttaggttacctttacgtaacgtcctttcgttacgttccgacggttaccctacggttacgttacgggactaacccggaaacccggttcccggtaccctacccgtacgtacccctaccgtcgttccggtaccgtacccttacgacggacgtacgcgactctactattacgtacgtcncgtntactacncgtaacaacgtacgacgtcggtacgtacggttggtcgggtaccgggtaaccggtaccggggtacccggtaaccgtaccgggttactacccgggtacggttacgaaccgtacccggaccggtaccgtccccgtaaccccggtcccgg

SEQ ID NO: 60802 - DNA, 763 bp, Homo sapiens
  misc_feature: GYAE6OF02IRO9Q.37.74.G08.1.454.CMB.1.raw
  modified_base (157)..(157): a, c, t, g, unknown or other
  misc_feature (157)..(157): n is a, c, g, or t
  modified_base (166)..(166): a, c, t, g, unknown or other
  misc_feature (166)..(166): n is a, c, g, or t
  modified_base (214)..(214): a, c, t, g, unknown or other
  misc_feature (214)..(214): n is a, c, g, or t
tcagtagtgtagatcacgaccggtgctcgatttagtagctctatcaggggggggtctcaggaggcagcgctctcaggacatctccacctatcggcctgggctctgcctgctcctcaccctccgtcactcagggctacacgggtcctgggcccagtcngcctgactngctgcctcgtgtctgggtctcctggaccagtccgatcaccatctcgtncactgaaccagcagtgacgttggtgttaactaatatcgtctacgttaggtaccaactacgtacaccgtaactacttacccaacctacgggtacctaaaccggtacccccgtaaatacccgtaatttaaacgttttacgtaacggacgggtacctaaccgtaaaaccgggtacccctacgtaacgggtacgtttacctaaacgttcggttactttaccgtaccgtgggtaaccctacccgtaaaggttcccgtacggggtaccctaaaccggtacccgggtacccttaccccgtttaccgaaacccgtacccggttaaccgttccgttaccgggggtaaccctaccgtaacccggtacggtaaccgggaacgtacggacctccgtaaccttacgtttaactacgacgtacgccttaacgtactaagtaaccgagtaccgtaggaccttaggtaccgttaggggttacgttacggggaccggtacgggaccgtaccgtacgtaccgttaccggttcgtcgaccggtaccgtacggtccgtacgtcccccgg

SEQ ID NO: 60803 - DNA, 870 bp, Homo sapiens
  misc_feature: GYAE6OF02HLIUH.37.74.G08.1.454.CMB.1.raw
tcagtagtgtagatcacgaccggtgctcgatttagtagctctatcaggggggggggtctcaggaggcagcgctctcaggacatctccaccatggcctgggctctgctgctcctcaccctcctcactcgagggcacgagggtccgtcgggcccagtctcgccctgactcacgtcctcgcccttccggtgttcgttcgggtccttccgtcgggaactacggtcgtactacccacctacttccttcccgtcggacctaacgtacggaaacccaacggcgtaggttacggttacggtttacgggtttacggtttaaacttaaacgtttaacgttcgttttccgttaccggtttaaccgggtaaaccctaaactaccgtaacccgtaaaccccggacgggaaaccctaaaaccccggtaaaccccctaaaacccgtctaacgtttacgttaaagttttaaggtacgggtaaccgttaaccgtaaaacccggttaaaaccccggtccccggttaacggggttaaccgggttccttaacgttaacgtccgttcctttaccgtcggtacgttccctaaccgtacgttccgtacggtaaccaaccggtacccgtccctacccgtacgtacctacgttccgttcggtccggtacctcggaccggtctaagggaccgacgacgtacctacgttactttattacgttcgcactactacgtataacgtacgaacgtgactacttaagtccgttagggtttgggtacccggggttacggtaccggggtaacgtacccggtaccgttcccgggttacgttaccggttaacgttacccggaccggaacccgttaccgggcccttaccccggttaccccggtcccgg

SEQ ID NO: 60804 - DNA, 176 bp, Homo sapiens
  misc_feature: GYAE6OF01EI97P.12.53.E09.1.454.CMB.1.raw
  modified_base (171)..(176): a, c, t, g, unknown or other
  misc_feature (171)..(176): n is a, c, g, or t
tcagatacgacgtacacgaccggtgctcgatttagagagagtgtgttgggtttggggaagaggaagactgacggtccccaggagttcaggtgctgggcacagcggccctgggctgcctggtcaaggactacttcctacgtcgtatctgagcgggctggcaaggcgcatagnnnnnn

SEQ ID NO: 60805 - DNA, 172 bp, Homo sapiens
  misc_feature: GYAE6OF01CK0SZ.12.53.E09.1.454.CMB.1.raw
  modified_base (171)..(172): a, c, t, g, unknown or other
  misc_feature (171)..(172): n is a, c, g, or t
tcagatacgacgtacacgaccggtgctcgatttagagagagtgtgttgggtttggggaagaggaagactgacggtccccaggagttcaggtgctgggcacagcggccctgggctgcctggtcaaggactacttcctacgtcgtatctgagcgggctggcaaggcgcatagnn

SEQ ID NO: 60806 - DNA, 513 bp, Homo sapiens
  misc_feature: GYAE6OF01CW0OL.12.53.E09.1.454.CMB.1.raw
  modified_base (408)..(408): a, c, t, g, unknown or other
  misc_feature (408)..(408): n is a, c, g, or t
  modified_base (507)..(507): a, c, t, g, unknown or other
  misc_feature (507)..(507): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgatttatgaggcactaagcggcctcaggggtttcttatcgcttctctggctccgagtctgactacacggcctccctgaccatctctgggctccaggctgaggacgaggctgattattatgcagctcatatacaagcagcagcaccctntttgtcttggaagtgggaccaaggtcaccgtcctacgtcacgcccaaggccaaccccactgtccactctcgttccccaccctcctctacgtctatctgngtcggg

SEQ ID NO: 60807 - DNA, 383 bp, Homo sapiens
  misc_feature: GYAE6OF01BP49N.12.53.E09.1.454.CMB.1.raw
  modified_base (380)..(383): a, c, t, g, unknown or other
  misc_feature (380)..(383): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctcgccccctcggtcactctgttcccaccctcctctacgtcgtatctgagcgggctggcaaggcgcatagnnnn

SEQ ID NO: 60808 - DNA, 517 bp, Homo sapiens
  misc_feature: GYAE6OF01B4MQH.12.53.E09.1.454.CMB.1.raw
  modified_base (510)..(510): a, c, t, g, unknown or other
  misc_feature (510)..(510): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctcaggctgaggacgaggcggattattactgttgctcatatgcgggtagtagctactttcgatgtcctagttcggcggagggaccaagctgaccgtctgggtcagcccagactcgcccctggtcactctgttcccgccctcctctacgtcgtatctgngcggtcg

SEQ ID NO: 60809 - DNA, 549 bp, Homo sapiens
  misc_feature: GYAE6OF01EOZB3.12.53.E09.1.454.CMB.1.raw
  modified_base (541)..(541): a, c, t, g, unknown or other
  misc_feature (541)..(541): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgatttatgagggcactaagcggccctcaggggtttctatcgcttctctggctccgagtctggcaacacggcctccctgacaatctctgggctccaggctgaggacgaggcggattattactgttgctcatatggcggtagtagctactttcgattgtcctagttcggcgggagggaccaagctggaccgtcgttgggtcagcccgaaggcctcggccccccttcgggtcctaccgtccttcgttcccccaccccttccctcgtaccgtcgtactcgtcgngcgggtcg

SEQ ID NO: 60810 - DNA, 513 bp, Homo sapiens
  misc_feature: GYAE6OF01AIRST.12.53.E09.1.454.CMB.1.raw
  modified_base (452)..(452): a, c, t, g, unknown or other
  misc_feature (452)..(452): n is a, c, g, or t
  modified_base (482)..(482): a, c, t, g, unknown or other
  misc_feature (482)..(482): n is a, c, g, or t
  modified_base (505)..(505): a, c, t, g, unknown or other
  misc_feature (505)..(505): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctcaggggtttctatcgcttctctggctccgagtctggcaacacggcctccctgacaatctctgggctccaggctgaggacgaggcggattattactgttgctcatatgcgggtagtagctactttcgatgtcctattcggcgagggaccaagctgaccgtctggtcngccagctgcccctcgtcacgtctgttcccnccctcctctacgtctactctcgngcgggtcg

SEQ ID NO: 60811 - DNA, 522 bp, Homo sapiens
  misc_feature: GYAE6OF01ER2G4.12.53.E09.1.454.CMB.1.raw
  modified_base (501)..(501): a, c, t, g, unknown or other
  misc_feature (501)..(501): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccaagtctgcaaaacggctcctgaccatctctggactccagcctgaggacgaggccgattactactgcattgcacagacaaggagtcccattgggtgttcggcggagggaccaaacgtgaccgtcctaggtcagcccaaggctgccccctggtccactctcgttcccgccctcctctacgtcggtntctgacgcggctggcaggcgc

SEQ ID NO: 60812 - DNA, 523 bp, Homo sapiens
  misc_feature: GYAE6OF01D4I5U.12.53.E09.1.454.CMB.1.raw
  modified_base (517)..(517): a, c, t, g, unknown or other
  misc_feature (517)..(517): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggacaaaaaacggccctcggggatttctaatcgcttctctggctccaagtctggcaacacggcctccctgacaatctctgggctccaggctgaggacgaggctgattattactgctgctcatatgcaggtagtggcacttttcgctactattcgggcggagggaccaagctgaccgtcctacgtcagcccaaggcctcgcccctcggtcactctgttccccgccttccctctacgtcgtactctgngcgggc

SEQ ID NO: 60813 - DNA, 508 bp, Homo sapiens
  misc_feature: GYAE6OF01AJVU9.12.53.E09.1.454.CMB.1.raw
  modified_base (502)..(502): a, c, t, g, unknown or other
  misc_feature (502)..(502): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgatttatgagggcactaagcggccctcaggggtttcttatcgcttctctggctccgagtctggcaacacggcctcctgacaatctctggctcaggctgaggacgaggcggattattactgttgctcatatggcggtagtagctactttcgatgtcctagttcggcggaggaccaagctgaccgtcgtggtcagccagctcgccctcgtcacgtctgttcccgccctcctctcgtctatctgngtggcg

SEQ ID NO: 60814 - DNA, 510 bp, Homo sapiens
  misc_feature: GYAE6OF01DDL9K.12.53.E09.1.454.CMB.1.raw
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgattatgagggcactaagcggccctcaggggtttcttatcgcttctctggctccgatctggcaacacgctccctgacaatctctggctccaggctgaggacgaggcggattattactgttgctcatatggcggtagtagctactttcgatgtcctattcggcgaggaccaagctgaccgtctggtcagccaggctcgcccctcggtcacgtctgtcccgccctcctctacgtcgtanctgngcgggtcg

SEQ ID NO: 60815 - DNA, 556 bp, Homo sapiens
  misc_feature: GYAE6OF01B84Y5.12.53.E09.1.454.CMB.1.raw
  modified_base (327)..(327): a, c, t, g, unknown or other
  misc_feature (327)..(327): n is a, c, g, or t
  modified_base (449)..(449): a, c, t, g, unknown or other
  misc_feature (449)..(449): n is a, c, g, or t
  modified_base (506)..(506): a, c, t, g, unknown or other
  misc_feature (506)..(506): n is a, c, g, or t
tcagatacgacgtacacgaccggtgctcgatttagagagagtgtgttgggtttggggctgggcctcaggaagcagcatcggaggtgcctcagccatggcatggatcctctcttcctcggcgtccttgcttactgcacaggttccgtggcctcgtatgacctgactcagccaccctctgtgtccgtcgtcccaggacagacagtcacaatctcatgctctggagatgcagttagggggaaagtttgctttcgtggtatcagcagagccaggccacgtcccctgtcttggtcatctataagatagcaggccgcctgagggtacttccgngacgcgtattccgtccggctaccaacgtccggacaacacagccactctcgaccatcgacggccggggacccagggcctcgtcgagtgacggctaggacctatacgtcgccgaggcgtggacncggtcctccgtacctttccgtagtcgtccgttgggacggtcggactagtcggtaccnccggtcctacggtccacgtaccccaacgaaccccaccctagtcgtacccg

SEQ ID NO: 60816 - DNA, 519 bp, Homo sapiens
  misc_feature: GYAE6OF01DZ61G.12.53.E09.1.454.CMB.1.raw
  modified_base (480)..(480): a, c, t, g, unknown or other
  misc_feature (480)..(480): n is a, c, g, or t
  modified_base (511)..(511): a, c, t, g, unknown or other
  misc_feature (511)..(511): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaaactcatgatttatgagggcactaagcggcctcaggggtttcttatcgcttctctggctccgagtctggcaacacggcctccctgacaatctctgggctcaggctgaggacgaggcggattattactgttgctcatatgcgggtagtagcactttcgatgtcctattcggcggaggaccaagctgaccgtcctggtcagcccaagctcgcccctcggtcactctnttcccaccctcctcttaccgtctactgtcgngcgggtcg

SEQ ID NO: 60817 - DNA, 383 bp, Homo sapiens
  misc_feature: GYAE6OF01C1FLC.12.53.E09.1.454.CMB.1.raw
  modified_base (378)..(383): a, c, t, g, unknown or other
  misc_feature (378)..(383): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccaccctcctctacgtcgtatctgagcggctggcaaggcgcatagnnnnnn

SEQ ID NO: 60818 - DNA, 522 bp, Homo sapiens
  misc_feature: GYAE6OF01EU77D.12.53.E09.1.454.CMB.1.raw
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgatttatgagggcactaagcggccctcaggggtttctatcgcttctctggctccgagtctggcaacacggcctccctgacaatctctgggctccaggctgaggacgaggcggattattactgttgctcatatgcggtagtagctactttcgatgtcctattcggcggagggaccaagctgaccgtcgtggtcagcccaaggctcgccccctcggtccacgtctgttccccaccctcctctacgtcgtactngngcgggtcg

SEQ ID NO: 60819 - DNA, 509 bp, Homo sapiens
  misc_feature: GYAE6OF01D5O8Q.12.53.E09.1.454.CMB.1.raw
  modified_base (403)..(403): a, c, t, g, unknown or other
  misc_feature (403)..(403): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (497)..(497): a, c, t, g, unknown or other
  misc_feature (497)..(497): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttagtaaccttgtctcctggtaccaacaacacccaggcaaagccccaaatcatgatttatgaggcactaagcggcctcaggggtttctgatcgcttctctggctccaagtctgactacacgcctcctgaccatctctggctccaggctgagacgagctgattatattgcagctacatatacagcagcagcacctntttgcttcgaagtcggacaggtcaccgtctacgtaagccaaaggcccaaccnctcgtacncttctcgttccccacccttcctcgtacgtcttancttgagtccggg

SEQ ID NO: 60820 - DNA, 521 bp, Homo sapiens
  misc_feature: GYAE6OF01EWXLW.12.53.E09.1.454.CMB.1.raw
  modified_base (485)..(485): a, c, t, g, unknown or other
  misc_feature (485)..(485): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaaatcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgattgtcctattcggcggagggaccaagctgaccgtctgggtcagcccaaggcctgccccctcggtcactctnttccccaccctcctctaccgtctatcngngcggtcg

SEQ ID NO: 60821 - DNA, 524 bp, Homo sapiens
  misc_feature: GYAE6OF01BF5LE.12.53.E09.1.454.CMB.1.raw
  modified_base (331)..(331): a, c, t, g, unknown or other
  misc_feature (331)..(331): n is a, c, g, or t
  modified_base (492)..(492): a, c, t, g, unknown or other
  misc_feature (492)..(492): n is a, c, g, or t
  modified_base (516)..(516): a, c, t, g, unknown or other
  misc_feature (516)..(516): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcgaggggtttcttatcgcttctctggctccgagtctggcaacncggcctcctgacatctctgggctcaggctgaggacgaggcggtattattactgttgctcatatgcgggtagtagctactttcgatgtcctagttcggcggaggaccagctgaccgtccgtggtcacgcccaggctcgcccctcggtccacgtctgttcccncccttcctcgtacgtcgtatctgngcgggtcg

SEQ ID NO: 60822 - DNA, 539 bp, Homo sapiens
  misc_feature: GYAE6OF01DAEWU.12.53.E09.1.454.CMB.1.raw
tcagatacgacgtacacgaccggtgctcgatttagagagagtgtgttgggtttgggggcgtttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgagggcactaagcggcctcagggtccctgaccgattctctggctcagtctggcacctcagcctcctggccatcagtggctcagtctgaggatggagctgtattattactgtgcatcatgggctgaccacctgacgtggtccgggagttggttcgggcgggagggaccaaggcgtcgaccgttcctaggtcacgacccgaaggccgacgcccccgtcggtcctacctccgttcgttccccgcccttcctccttacgtccgtattcgtacgg

SEQ ID NO: 60823 - DNA, 639 bp, Homo sapiens
  misc_feature: GYAE6OF01CQ1WG.12.53.E09.1.454.CMB.1.raw
  modified_base (269)..(269): a, c, t, g, unknown or other
  misc_feature (269)..(269): n is a, c, g, or t
  modified_base (328)..(328): a, c, t, g, unknown or other
  misc_feature (328)..(328): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctctggtaaccaacaacaccaggacaaacgccccaaactcatgatttangaggcactaagcggccctgagggtttctatcgcttctctggctccgagtctggacaacncggcctccctagaccaatctcgtcgggcctccgaggctggaacggacgaggcggtattacgttactgttgctacagtagtggacggttagtacgtcttactttcgattgttaccgttagttcgggacgggtaagggaccaaggtccgtacggtacccggttccgtcgggttaccacggtaccccgaacgggtcccgtaccggtccccccgtcgggtaccctacccgttcccgttcccggttcccccgtccccgtttcccgttccgttacccggttccgttacgttccggtacggcgggtccgggtaccggg

SEQ ID NO: 60824 - DNA, 534 bp, Homo sapiens
  misc_feature: GYAE6OF01AKIKR.12.53.E09.1.454.CMB.1.raw
  modified_base (337)..(337): a, c, t, g, unknown or other
  misc_feature (337)..(337): n is a, c, g, or t
  modified_base (503)..(503): a, c, t, g, unknown or other
  misc_feature (503)..(503): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgccccaaactcatgatttatgagggcactaagcggccctcgagggtttctatcgcttctctggctccgagtctggcacacggcctccngacaatctcgtgggctccgagctgacggacgaggcggattattactgttgctcatatggtcgggtagtagctactttcgattcgtccttagttcggcggaggaccaagctacggaccgtccgtgggtcacgccgagcctcgcccctcggtctacgtctcgttcccnccctcctctacgtcgtactcncgngcggtcg

SEQ ID NO: 60825 - DNA, 525 bp, Homo sapiens
  misc_feature: GYAE6OF01A4MQA.12.53.E09.1.454.CMB.1.raw
  modified_base (483)..(483): a, c, t, g, unknown or other
  misc_feature (483)..(483): n is a, c, g, or t
  modified_base (516)..(516): a, c, t, g, unknown or other
  misc_feature (516)..(516): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatggcgggtagtagctactttcgatgtcctagttcggcggagggaccaagctacgaccgtcgtggtcacgccgaggctcgcccctcgtcnctctcgttcccgcctcctcttacgtcgtactcngcgcggtcg

SEQ ID NO: 60826 - DNA, 536 bp, Homo sapiens
  misc_feature: GYAE6OF01DNQLR.12.53.E09.1.454.CMB.1.raw
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaatcatgatttatgaggcactaagcggccctcaggggtttcttatcgcttctctggctccgagtctggcaacacggcctccctgacaatctctgggctcaggctgaggacgaggcggattattactgttgctcatatggcgggtagtagctactttcgattgtcctagttcgggcggagggaccaaggctgaccgtccgtgggtcacggcccaaggcctacgccccctcggtcaccgtctcgttccccncccttcctctaccgtcgtatctgngtcgggtcg

SEQ ID NO: 60827 - DNA, 539 bp, Homo sapiens
  misc_feature: GYAE6OF01D71KJ.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgccttcgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctcctgacaatctctgggctccaggctgaggacgaggcggattattactgttgctcatatgcgggtagtagctactttcgattcgtcctattcggcggaggaccaagctgaccgtcgtgggtcacgcccaggcctcgccccctcggtccacctcgtccgttccccctccctacgttccgtactctacggagccgggctgggaccg

SEQ ID NO: 60828 - DNA, 376 bp, Homo sapiens
  misc_feature: GYAE6OF01CDCOB.12.53.E09.1.454.CMB.1.raw
  modified_base (374)..(376): a, c, t, g, unknown or other
  misc_feature (374)..(376): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtatagcactttcgatgtcctattcggcggagggacaagctgaccgtcctgggtcagcccaaggctgccccctggtcactctgttcccaccctctctacgtcgtatctgagcggctggcaaggcgcatagnnn

SEQ ID NO: 60829 - DNA, 384 bp, Homo sapiens
  misc_feature: GYAE6OF01COZDW.12.53.E09.1.454.CMB.1.raw
  modified_base (378)..(384): a, c, t, g, unknown or other
  misc_feature (378)..(384): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtctgggtcagcccaaggctcgcccctcggtcactctcgttcccgccctcctctacgtcgtatctgagcggctggcaaggcgcatagnnnnnnn

SEQ ID NO: 60830 - DNA, 173 bp, Homo sapiens
  misc_feature: GYAE6OF01DDUFA.12.53.E09.1.454.CMB.1.raw
  modified_base (173)..(173): a, c, t, g, unknown or other
  misc_feature (173)..(173): n is a, c, g, or t
tcagatacgacgtacacgaccggtgctcgatttagagagagtgtgttgggtttgggggaagaggaagactgacggtcccccaggagttcaggtgctgggcacagcggccctgggctgcctggtcaaggactacttcctacgtcgtatctgagcgggctggcaaggcgcatagn

SEQ ID NO: 60831 - DNA, 573 bp, Homo sapiens
  misc_feature: GYAE6OF01EYG1A.12.53.E09.1.454.CMB.1.raw
  modified_base (390)..(390): a, c, t, g, unknown or other
  misc_feature (390)..(390): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagcggccctcgaggggtttcttatcgcttctctggctccgagtctgcaacacggcctcctgacaatctctgggctcaggctgaggacgaggcggattattactgttgctnatatggcgggtagtagctactttcgattcgtccttagttcgggcgggacggaccgaagcgtacgaccgtccgtcgggtcacgcccgaggccgtcgtccccccgtcggtcctaccgttccttccgttcccccgccccttcccgttccttaccgttccgttacttcgtcggtcggtccgggtcgg

SEQ ID NO: 60832 - DNA, 596 bp, Homo sapiens
  misc_feature: GYAE6OF01D8LSY.12.53.E09.1.454.CMB.1.raw
  modified_base (331)..(331): a, c, t, g, unknown or other
  misc_feature (331)..(331): n is a, c, g, or t
  modified_base (553)..(553): a, c, t, g, unknown or other
  misc_feature (553)..(553): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataacttgtctctgtaccaacaacacccaggcaaacgccccaaactcatgtatttatgagggcactaagcggccctgaggggtttcttatcgtcttctctggcctccgagtctggccaacnccggtccctccctgacaatcctcgtcgggcctccgaggctggagggtacgagggcggtaattattacgttgttgctatatagtggacgggtagtagtcctacgtttcgattcgttaccgttagttccgggcggaagggaccaaggtcctaggacccgttccgtgggtccgacgacccgaggcctcggtcccccgtcggtcctaccgtcccttcgttcccccncccttccctcgttaccgtacctacgtggacgtcggcgtacggg

SEQ ID NO: 60833 - DNA, 384 bp, Homo sapiens
  misc_feature: GYAE6OF01DGG60.12.53.E09.1.454.CMB.1.raw
  modified_base (378)..(384): a, c, t, g, unknown or other
  misc_feature (378)..(384): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccacctcctctacgtcgtatctgagcggctggcaaggcgcatacgnnnnnnn

SEQ ID NO: 60834 - DNA, 587 bp, Homo sapiens
  misc_feature: GYAE6OF01DRRGT.12.53.E09.1.454.CMB.1.raw
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctctgtaccaacacaccaggcaaagccccaaatcatgatttatgaggcactaagccggccctcaggggtttcttatcgtcttctctggctccgagtctggcaacncggcctcctgacatctntggctcgagctgaggacgaggcgtattattctgttcgctcatatcgggtcggtagtagtctacgtttcgatcgtccttaggttccggacgggacggaccgaagtcgtacgaccggtccgtgggtccacggtacccgaggcccgttacccgcccccgtacggtcctaccgttccgttcccggttcccctccccgttcccttacccgttaccgttccggttacttccgtcggtcggtccgggtacgg

SEQ ID NO: 60835 - DNA, 545 bp, Homo sapiens
  misc_feature: GYAE6OF01BYRRV.12.53.E09.1.454.CMB.1.raw
  modified_base (435)..(435): a, c, t, g, unknown or other
  misc_feature (435)..(435): n is a, c, g, or t
  modified_base (536)..(536): a, c, t, g, unknown or other
  misc_feature (536)..(536): n is a, c, g, or t
tcagatacgacgtacacgaccggtgctcgatttagagagagtgtgttgggtttgggggcgtttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgatttatgagggcactaagcggccctcaggggtttctatcgcttctctggctccgagtctggcaacacggcctccctgcaatctctgggctccaggctgaggacgaggcggattatactgttgtgtcagtatagtcggtaggtagacgacttcgtatgtcgtacttggtcggnggacgacgacgtgaccgtccgtcggtcgtacgccgaccgacgtcgcccgtcccggtcgaccgtctcgttcccgtcccctcctcctacgtcgtactactcgngcggtccgg

SEQ ID NO: 60836 - DNA, 522 bp, Homo sapiens
  misc_feature: GYAE6OF01CG9GS.12.53.E09.1.454.CMB.1.raw
  modified_base (328)..(328): a, c, t, g, unknown or other
  misc_feature (328)..(328): n is a, c, g, or t
  modified_base (492)..(492): a, c, t, g, unknown or other
  misc_feature (492)..(492): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaagcccccaaatcatgatttatgagggcactaagcggccctcaggggtttcttatcgcttctctggctccgagtctggcaacncggcctccctgacaatctctgggctccgaggctgaggacgaggcggattattactgttgctcatatggcggtagtagctactttcgattgtcctagttcggcggaggaccaagctgaccgtcgtggtcagcccagcctcgcccctcggtcactctcgttccccncctcctctaccgtctacnctgnggcggtcg

SEQ ID NO: 60837 - DNA, 174 bp, Homo sapiens
  misc_feature: GYAE6OF01EEHHK.12.53.E09.1.454.CMB.1.raw
  modified_base (173)..(174): a, c, t, g, unknown or other
  misc_feature (173)..(174): n is a, c, g, or t
tcagatacgacgtacacgaccggtgctcgatttagagagagtgtgttgggtttgggggaagaggaagactgacggtcccccaggagttcaggtgctgggcacagcggccctgggctgcctggtcaaggactacttcctacgtcgtatctgagcgggctggcaaggcgcatagnn

SEQ ID NO: 60838 - DNA, 525 bp, Homo sapiens
  misc_feature: GYAE6OF01EXHNP.12.53.E09.1.454.CMB.1.raw
  modified_base (522)..(523): a, c, t, g, unknown or other
  misc_feature (522)..(523): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcagttgggtgttcgggcggcgggacaagtgaccgtctagtcagcccaaggctcgcccctcggtctactttcgtccctccctccctctacgtcgtatctgacgcggctggcaaggcnntg

SEQ ID NO: 60839 - DNA, 573 bp, Homo sapiens
  misc_feature: GYAE6OF01DI858.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactggaccagcagtgatgttggacttataaccttgtctcctggtaccaacaacacccaggacaaacgcccccaaaatcatgattatgaggcactaagcggcctcgaggggtttctgatcgcttctctggctacgaggctcggcgacccggcctccctgactaatatctgggctccgaggctggaacggacgaggctaccgtaatttacctactgctgccttacgatagtagggagttataggtctacggtttgggtcggttcgggaccggtacgggaactaaacggtcgtaaccgttaccgtaaacgtcacgacccgaacgcctccgacccccgttgtcacctctccgttccccaccttcctctacgtcgtatcagacggcgtcgtgaccg

SEQ ID NO: 60840 - DNA, 530 bp, Homo sapiens
  misc_feature: GYAE6OF01BG6TF.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaatcatgatttatgaggcactaagcggccctcgaggggtttcttatcgcttctctggctccgagtctgcaacacggcctcctgacaatctctgggctccgaggctgaggacgaggcggtattattactgctgctcatatgcgaggtagtgctacttcgactactagtcggcggacgggacaagctcgaccgtcctacgtcacgcccgaacggcctcgccccctcggtcctacctctcgttccccacccttcctctacgtcgtatctgcgtcggg

SEQ ID NO: 60841 - DNA, 385 bp, Homo sapiens
  misc_feature: GYAE6OF01BEVSP.12.53.E09.1.454.CMB.1.raw
  modified_base (377)..(385): a, c, t, g, unknown or other
  misc_feature (377)..(385): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctggtcactctcgtcccaccctcctctacgtcgtatctgagcggctggcaaggcgcatagnnnnnnnnn

SEQ ID NO: 60842 - DNA, 184 bp, Homo sapiens
  misc_feature: GYAE6OF01DL7BY.12.53.E09.1.454.CMB.1.raw
  modified_base (176)..(184): a, c, t, g, unknown or other
  misc_feature (176)..(184): n is a, c, g, or t
tcagatacgacgtacacgaccggtgctcgatttagagagagtgtgttgggtttggggggaagaggaagactgacggtcccccaggagttcaggtgctgggcacagcggccctgggctgcctggtcaaggactacttccctacgtcgtatctggagcgggctggcaaggcgcatagnnnnnnnnn

SEQ ID NO: 60843 - DNA, 532 bp, Homo sapiens
  misc_feature: GYAE6OF01COAAV.12.53.E09.1.454.CMB.1.raw
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
tcagatacgacgtacacgaccggtgctcgatttagagagagtgtgttgggtttgggggctttgcctgggctctgctgctcctcactctcctcactcaggacacagggccctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgaggcactaagcggcctcaggggtttcttatcgcttctctggctccgagtctggcaacacggcctccctgacaatctctgggctcaggctgaggacgaggcggattattactgttgctcatatggcgggtagtagctactttcgattgtcctagttcgggacggacggaccaaggctagaccgtcgtgggtcacgcccaggcctcgcccctcggtcacgtctcgttccccgcccttcctcctacgtctactncgnggtcggtcg

SEQ ID NO: 60844 - DNA, 541 bp, Homo sapiens
  misc_feature: GYAE6OF01B62DA.12.53.E09.1.454.CMB.1.raw
  modified_base (533)..(533): a, c, t, g, unknown or other
  misc_feature (533)..(533): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgaggcactaagcgccctcgaggggtttcttatcgcttctctggctccgagtctgcaacacggccctcctgaccaatctctgggctccgaggctggaggacgaggcggtattattactgttgctcatagtggacgggtagtagctactttgattgtcctagttcggcgagggaccaagctcgaccgtccgtgggtcacgacccgaggcctccgccccgtcggtccaccgttctccgttcccaccctcctcctacgtcgtatcgtgngcgggtcg

SEQ ID NO: 60845 - DNA, 562 bp, Homo sapiens
  misc_feature: GYAE6OF01C0XNL.12.53.E09.1.454.CMB.1.raw
  modified_base (338)..(338): a, c, t, g, unknown or other
  misc_feature (338)..(338): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgaggcactaagcggccctcaggggtttcttatcgcttctctgctccgagtctggcaacacggcctccngacatctctggctcaggctgaggacgaggcggattatactgtgctcatatggcgggttagtagctactttcgattcgtcctagttcggcgggacggaccaagctcgaccgttcgtgggtcacgacccgaggcctccgtccccctccgggtctaccgtccgttcggttcccccgccccttccttcccgttaccggttccgtacttccgtaggcggtccgggtcgg

SEQ ID NO: 60846 - DNA, 549 bp, Homo sapiens
  misc_feature: GYAE6OF01AM8UZ.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacagcacccaggcagacgcccccaaactcatgatttatgaggcactaagcggccctcgaggggtttctatcgcttctctggctccgagtctggcacacggcctcctgacatctctggctccgaggctgaggacgaggcgtattattactgttgctcatatggcgggtatagctactttcgattcgtcctagttcgggcggacgggaccaaggcgtcggaccgttccgtgggtccacggcccaggtcctccgcccccgtcggtcctaccgttccgtccgttccccacccttccctcttaccgtcgtactcgtggacgg

SEQ ID NO: 60847 - DNA, 832 bp, Homo sapiens
  misc_feature: GYAE6OF01BVWHE.12.53.E09.1.454.CMB.1.raw
tcagatacgacgtacacgaccggtgctcgatttagagagagtgtgttgggtttgggggctttgcctgggctctgctgctcctcactctcctcactcagggcacagggtcctgggcccaatctgccctgactcagcctgcctccgtgtctgggtctcctggacagtcgatcaccatctcctgcactgcaaccagcagtgacgttaatgaataataactatttctcctggtaccagcaacaccaggaccaaaacgccccaaactcctactattagtggtgtacggaactccggcctggtacggggtttactaacgtcggtcctttctcgtcggtcctaccgtaaggttcgtacggaaccgaaaaccgggtcccctcccgtacgaccctacttccgtcgtacggaccttccgacgcccgtaggaacggacgacgggtaccgttaacttaccgtacgtcggtactacgttcgacctaacgaacgtaaccgtaaacgggtacccgttacccgtaagggttttcggggtacgggtttaccggggaaccggggtaaccggtaaacccgtaaaccggtccgggtaacccggttacccggttaacgggtacccgaacccggtaacccggtaaccgggtccccgttaccccggtaccccccggtttacgggaccccttaccccggttacccggttttaccccgttaccccccccgtaaaccccgttttccccgttaaccggtttaaccccggtttacggtttaaccccgttcccggtaaccggggtaccggtaccccgggggtcgttaacccggggaacccggaacgggtcccgtaaaccgg

SEQ ID NO: 60848 - DNA, 381 bp, Homo sapiens
  misc_feature: GYAE6OF01BLIGL.12.53.E09.1.454.CMB.1.raw
  modified_base (377)..(381): a, c, t, g, unknown or other
  misc_feature (377)..(381): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctggtcactctgttcccaccctcctctacgtcgtatctgagcggctggcaaggcgcatagnnnnn

SEQ ID NO: 60849 - DNA, 584 bp, Homo sapiens
  misc_feature: GYAE6OF01D6N8K.12.53.E09.1.454.CMB.1.raw
  modified_base (327)..(327): a, c, t, g, unknown or other
  misc_feature (327)..(327): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgccccaaactcatgatttatgaggcactaagcggcctcgaggggtttctatcgcttctctgctccgagtctggcaacncggcctcctgacaatctcgtgggctccgaggctggaggacgaggcggtattattactgttgctcatagtggtacggtagtagctacgtttcgatcgttacctagttcgggacggtacgggaccaagcgtacgacccggtcgtcgggtacacgacccgaaggtcctccggcccccgtcggtcctaccgtccttccgttccccctacccttcccgtaccgttaccgttaccgttactacgtcggtcggtccgggtccgg

SEQ ID NO: 60850 - DNA, 627 bp, Homo sapiens
  misc_feature: GYAE6OF01EKTVG.12.53.E09.1.454.CMB.1.raw
  modified_base (274)..(274): a, c, t, g, unknown or other
  misc_feature (274)..(274): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaaccacccaggaccaaacgcccccaaactcatgtatttangaggcactaagccggccctcgtaggggtttctagtccgtcttctcgtggctccgagtctgcacgccgcctccngacatctcnggctcgnggctggacggacgaggtacggtatttacttacgtgttcgtccttacagttagtggtacgggtagtacgtactaccgtttcgagttcgtcttacgttccgggacggtacgggacctacgcgtacgtacccggttccgtcgggtaccgacggacccgacggtccgtcccgtcccccgtccggtcctacccgttccgttccccgttccccctaccccgttcccctaccgttaccgttccgtaccttcgcggtacggtccggtaccgg

SEQ ID NO: 60851 - DNA, 602 bp, Homo sapiens
  misc_feature: GYAE6OF01CR5F1.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctggtaccaacaacacccaggcaaagcccccaaatcatgatttatgaggcacgtaagccggcctcgaggggtttcttatcgtcttctctggctccgtagtctggcaacgccggcctcctgacatctcgtggctcagctgaggcgaggcgtattattacgtgttcgcttacattagtggacgggttagtacgtctacttttcgagttcgtcgtagttcgggacggacgggaccagtcgtacgtaccggttcgtgggtccacggaccgacggtcctccggtcccccgtacgggtcctaccgttccgttcccgtttacccccaccccttcccgttacccgttaccgttaccggtacgttccggacgggtccgggcggtacggg

SEQ ID NO: 60852 - DNA, 576 bp, Homo sapiens
  misc_feature: GYAE6OF01DSG39.12.53.E09.1.454.CMB.1.raw
  modified_base (310)..(310): a, c, t, g, unknown or other
  misc_feature (310)..(310): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctctggtaccaacaacaccaggcaaagccccaaatcatgattatgaggcactaagcgccctcaggggtttctatcgcttctctggctcgntctggcaacacggcctcctgacaatctctcggctcaggctgaggacgaggcggtattattactgttgtctcatatggacggtagtagtctactttcgattcgtcctagttcgggacggaggaccgtaagccgtacgacccgtccgttcgggtccagacccgacggcctccggtcccccgtcggtacccacccgttcgtcccggtttcccccgccccttcccgtccgttaccggttccgtactcgttcggacggtccgggtacccgg

SEQ ID NO: 60853 - DNA, 523 bp, Homo sapiens
  misc_feature: GYAE6OF01AF7SR.12.53.E09.1.454.CMB.1.raw
  modified_base (516)..(516): a, c, t, g, unknown or other
  misc_feature (516)..(516): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgatttatgaggcactaagcggccctcagggtttctatcgcttctctggctccgagtctgcaacacggcctccctgacaatctctgggctccgaggctgaggacgaggcggattattactgttgctcatatgcgggtagtagctacttcgatgtcctagttcggcggaggaccagctcgaccgtcgtggtcacgcccagcctcgccccgtcggtcctacgtctcgttcccgccctccctctacgtcgtactcgtgngcggtcg

SEQ ID NO: 60854 - DNA, 544 bp, Homo sapiens
  misc_feature: GYAE6OF01BX42H.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctcgaggggtttcttatcgcttctctggctccgagtctggcacgacggcctccctgacaatctctcgggctccaggctggacggaccgagggcggtattacgttacgtgcagtttcaagtatacaacgtcacttccactctcggttggtgttcggcggtgggaccagctagaccgtctagtcacgcccaaggcctcgccccgtcggtccactccgtcgttcccaccctcctcctacgtctactcgagcggcggcgtcgg

SEQ ID NO: 60855 - DNA, 555 bp, Homo sapiens
  misc_feature: GYAE6OF01CLTV3.12.53.E09.1.454.CMB.1.raw
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (470)..(470): a, c, t, g, unknown or other
  misc_feature (470)..(470): n is a, c, g, or t
  modified_base (546)..(546): a, c, t, g, unknown or other
  misc_feature (546)..(546): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctnaggggtttcttatcgcttctctggctccgagtctggcaacncggcctcccnacaatctctgggctccaggctggaggacgaggcggatttattacgtgttgcttcattagtggtcgggtataggctactttcgagttcgtcctagttcggcggaggaccaagctagacccgtcgtgggtacncgacccaggcctcgccccctcggtccaccgttctccggttccccgcccttccctccttaccgtcgttactcgtcgnggccggtcg

SEQ ID NO: 60856 - DNA, 540 bp, Homo sapiens
  misc_feature: GYAE6OF01A06BY.12.53.E09.1.454.CMB.1.raw
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaaacgccccaaactcatgatttatgagggcactaagcggccctcgtaggggtttcttatcgcttctctggctccgagtctggcaacacggcctccctgacaatctcgtgggctccaggctggaggacgaggcggattattactgttgctcatagtggcggtagtagctacgtttcgattgtcctagttcgggcggacgggaccaagctcggaccgtcgtggtcagcccgaggcctcgcccctcggtcaccgtctccgttccccgcccttcctctcgtctactntcgngcggtcg

SEQ ID NO: 60857 - DNA, 589 bp, Homo sapiens
  misc_feature: GYAE6OF01CSOA5.12.53.E09.1.454.CMB.1.raw
  modified_base (334)..(334): a, c, t, g, unknown or other
  misc_feature (334)..(334): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagccggccctcgtaggggtttcttatcgtcttctctggctccgagtctgcaacncggcctccctgacatctctgggctccgaggctggacggacgaggcggtattattacttgttgcttacattagtggcgggttagtacgtctacgttttcgaagttcgttaccttagttccgggacgggacgggaccaaggtccgtacggacccggttccgtgggtccacggcccgaggcctccggcccccgtcggtcctaccgttcctccgttccccaccccttccctcgttaccgtcgtactcgtgcgcgggtcg

SEQ ID NO: 60858 - DNA, 611 bp, Homo sapiens
  misc_feature: GYAE6OF01A6J6E.12.53.E09.1.454.CMB.1.raw
  modified_base (400)..(400): a, c, t, g, unknown or other
  misc_feature (400)..(400): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagcggccctcgagggtttctatcgtcttctctggctccgagtctggcaacacggcctccctgacaatctcgtgggcctccgaggctggagggacggaggcggtaatttattacgtggttnctactatgtggcggtagtagactacgtttcgagttcgtccttagttccgggacgggaacgggacccaaggtccgtacgacccggtccgtcgggtccacggacccgaacggccgtccgcccccgttcggtccctaccgttccgttcccggttcccccgtccccttcccgttccgttacccgttccgttactcgtcggcgggtccgggtccgg

SEQ ID NO: 60859 - DNA, 628 bp, Homo sapiens
  misc_feature: GYAE6OF01BNEAG.12.53.E09.1.454.CMB.1.raw
  modified_base (269)..(269): a, c, t, g, unknown or other
  misc_feature (269)..(269): n is a, c, g, or t
  modified_base (321)..(321): a, c, t, g, unknown or other
  misc_feature (321)..(321): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatggttggacttataaccttgtctcctggtaccaacacacccaggaccaaacgccccaaatcatgatttangaggcacgtaagcgcctgtagggtttctagtcgtcttctctggctcgagtcngcaacgcgcctcctagacaatctcgtcgggcctccgaggtcgtaggacggacggacggtcggtaacttaggtttacgtggttcgacttcagtagtgggtacggtagtacgtaccttacgtttcgtagttcgtaccgttaggttcccgggacgggtaacgggaccaacggtccgtacggtacccggttcgtcgggtacacccggaccgagtccctaccggccccgttacggtcctacccgttcgtcccgttaccccgtcccgttcccgttacgttccgttccgtagccgtcggaccgggtcgtaccgg

SEQ ID NO: 60860 - DNA, 647 bp, Homo sapiens
  misc_feature: GYAE6OF01BEIN7.12.53.E09.1.454.CMB.1.raw
  modified_base (267)..(267): a, c, t, g, unknown or other
  misc_feature (267)..(267): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctgtaccaacaacacccaggacaaacgccccaaatcatgatttangaggcactaagcgcctctagggtttctatcgcttctctgctccgagtctggcaacacggcctcctgacaatctcgtcgggctccaggctaggaggacgtaggcggtattagttactaggttgcttcaattaagtgggtacgggttaagtagtacctacgttttacgtacgttcgttccgttaagttcccggggtacgggaacggggtaacccgtaaggtccgttaccggaacccggttcccgtacgggttacgacgaccccggaacggccgtacccgtcccccgttccggtaccctaccgttccgttcccggttcccccggtccccttacccttcccgttacggttcccgttacttccgacgggtaggccggggtaccgg

SEQ ID NO: 60861 - DNA, 529 bp, Homo sapiens
  misc_feature: GYAE6OF01DJ5V0.12.53.E09.1.454.CMB.1.raw
  modified_base (330)..(330): a, c, t, g, unknown or other
  misc_feature (330)..(330): n is a, c, g, or t
  modified_base (501)..(501): a, c, t, g, unknown or other
  misc_feature (501)..(501): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaatcatgatttatgaggcactaagccggccctcgaggggtttcttatcgcttctctggctcgagtctggcaacncgcctcctgacatctctggctccgaggctgaggacgaggcgtatttattactgttgctcatatggcgggttagtagctactttcgattcgtcctagttcgggcggacggaccagctcggaccgtcgtggtcacgcccaggcctccgcccctcggtctcctctccgttcccnccctcctctacgtctanctgngnggtcg

SEQ ID NO: 60862 - DNA, 513 bp, Homo sapiens
  misc_feature: GYAE6OF01CCFAB.12.53.E09.1.454.CMB.1.raw
  modified_base (390)..(390): a, c, t, g, unknown or other
  misc_feature (390)..(390): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacaccaggcaaagcccccaaatcatgatttatgagggcactaagcggccctcgtaggggtttcttatcgcttctctggctccgagtctggcaacaccggcctccctgacaatctctggctccgaggctgaggacgaggcggtattattactgttnctcatagtgcggtagtagcgtatttcgattcgtctagttcggcggaggaccagctgaccgtcgtggcagccgagctcgcccctggcnctctcgtcccncctctctcgtcactncgngcggtcg

SEQ ID NO: 60863 - DNA, 745 bp, Homo sapiens
  misc_feature: GYAE6OF01CKNIP.12.53.E09.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcacgtgggaccagcagtgatgtggtacttatacttgtctctgtacaacacaccaggacaacgaccccaancatagtattanagaggcacgtaagccggcctgtagggtttctagtcgtcttcgtctcggactccggtagtcgtacgaccaaccgtaccggcccttacccgtagaacctaacgttccgtacgttccggggccttaccggacggtccgtaggaacgggaccgagggtacggtatttaacgttacgttcgttcgactacgtagttacggtacggggtacgggttaagtaacgtccgtttaacggtttctaacggttacgtaccgtttaggttcccggggaacgggtaacggaacccgtaaggtcccgttacgggtaccccggttaccggtacgggttacccgaaccgtaccccggtacggacccgttccccggtaccccccgttcgggtacccttacccggtttacccgttccggttaccccccggtcccttaccccggttaacccgttaccggttccgttaacggttccgtacgggtaccggggtcggtaaccggg

SEQ ID NO: 60864 - DNA, 660 bp, Homo sapiens
  misc_feature: GYAE6OF01EE52O.12.53.E09.1.454.CMB.1.raw
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (624)..(624): a, c, t, g, unknown or other
  misc_feature (624)..(624): n is a, c, g, or t
tcagatacgacgtacacgaccggtgctcgatttagagagagtgtgttgggtttgggggctttgcctgggctctgctgctcctcactctcctcactcaggacacagggtcctgggcccaatctgccctgactcagcctgcctccgtgtctgggtctcctggacagtcgatcaccatttccngcaccggaacaatagtgacgttggtcgttataactttgtctcctggtacaacncgcacccaggcaaacgcccccaatcctgatttatgaggtcactattcggcctnagtatttcaatcgtcttctcgttcggttaccaagtctggaccaacgaccggtccctccctcgacctattccgtccggtcggggtccacgggtcgtaggaacgggtacggaacggtcgtagtaacttttacgtacgttcgaccgtattccaatttacgaacaacgacgagaccgactacctaccctttcgtttcgtacgtttacggggaacgttacgggaaccgtaaggtaccctacccgttaccgtaccgtacgaaccgtacccgaacgtaccccaacccgttctacgacctactcccgttccgttaccccgcccttccgtaccgtacggttactacncgtcgggaacgtcgggtactggaacgcgggtccaag

SEQ ID NO: 60865 - DNA, 505 bp, Homo sapiens
  misc_feature: GYAE6OF01DEGCG.12.53.E09.1.454.CMB.1.raw
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcagacgacccccaaatcatgtatttttgatgtacactaatccggcccctcgaggtagtttctgatcgcttctctggctcaaggcnggcgaccggcctcctgacaatatcgtgggctccgaggctgaggacgnggctcattacactgctgctcatagtggtagttatgctgttgggtgttcggcggcggacaaggtcgaccgtctagtcacgccagcctcgcccctgcnctctcgtccccacctctctcgtctntcngngcgg

SEQ ID NO: 60866 - DNA, 603 bp, Homo sapiens
  misc_feature: GYAE6OF01BY94Q.12.53.E09.1.454.CMB.1.raw
  modified_base (270)..(270): a, c, t, g, unknown or other
  misc_feature (270)..(270): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttangaggcataacgcgcctcgagggtttctatcgcttctctggctccgagtctggcaacaccggcctcctgacatctctcggggcctccaggctaggacgggacgaggcgtatttactactgttcgcttcatagtggcgggtagtagactacgtttcgattcggtccttaggttccggcgggaacgggaccctaagcgtacggacccgttccgtgggtaccacgtacccgaaggtcccgtccggtcccccgttcggtcctaccgttccgttcccgttacccccctacccttcccgtaccgttaccgtccgtacttccgtcgacgggtccgggtcgg

SEQ ID NO: 60867 - DNA, 531 bp, Homo sapiens
  misc_feature: GYAE6OF01DAK7P.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctctggtaccaacaacacccaggcaaagccccaaaatcatgatttatgagggcaactaagcggccctcaggggtttcttatcgcttctctggctccgagtctggcaacacggcctccctgacaatctctgggctccaggctgaggcgagcggattatactgttgctcatatggcgggtagtagctactttcgatcgttcctagttccggcggagggaccaagctcggacccgtctacgtccagcccaggctcgcccctcggtcacgtctcgttccccacccctctacgtcgtactctgacgcgggctacgg

SEQ ID NO: 60868 - DNA, 693 bp, Homo sapiens
  misc_feature: GYAE6OF01BX6FQ.12.53.E09.1.454.CMB.1.raw
  modified_base (273)..(273): a, c, t, g, unknown or other
  misc_feature (273)..(273): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaaccaacaacacccaggacaaacgccccaaatccatagtatttanggaggcactaagcgcctcgtaggggtttcttagtcgtctttctcgtcggctccgagtctggcaacgcggcctcctgacatctcgtggctcgagctgaggacgaggcgtattattacgtgttacgctactagtagtgggtacgggttagtagacttacgtttacgattcggttaccgttagtttccgggacgggtaacgggaacccgtaacggtcgttaccggtaacccggttcccggttagggttaccgaaccggtacccggaacgggttcccgtaccgggttacccccgttcgggttaacccgttacccgtttcccgttaccccgggtttacccccgtccccgtttaccccgttaccggttacccgtttaacccgggttcttacccggttacgggtacgggtcccgggttaacccgggg

SEQ ID NO: 60869 - DNA, 523 bp, Homo sapiens
  misc_feature: GYAE6OF01BBQOA.12.53.E09.1.454.CMB.1.raw
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggccctcaggagtttctgatcgcttctctggctccaaggctggcgaccgggcctccctgacaatatctgggctccgaggctggaggacgaggctcattactatgctgctcatagtggtaggttatagctacgttgggtgttcgggcggacggacaagtcgaccgtctaagtcacgccaggctcgccctcgtcnctctcgtcccacctcctcgtcgtcgtntcngcgcggctggnaggcgnag

SEQ ID NO: 60870 - DNA, 542 bp, Homo sapiens
  misc_feature: GYAE6OF01B8NP7.12.53.E09.1.454.CMB.1.raw
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
  modified_base (529)..(529): a, c, t, g, unknown or other
  misc_feature (529)..(529): n is a, c, g, or t
  modified_base (538)..(538): a, c, t, g, unknown or other
  misc_feature (538)..(538): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaactaccccggacaaaacgtccccaaagttaactctatttatgagggcaacgtaagccggccctcaggtatttctgatcgcttctctggctccgaaggctggcgaccggcctccgtgacaatatcgtggctcgaggctgacggacgaggctcattactatgctgctnatagtggagttanagctacgttgggtgtcgggcggcggaacgaagtcgaccgtctaagtcacgccagccgtcgccccgtcgtctactccgtcgtcccgccctcctcgtcgtctactcgcgagcggtcngacaggcgngtag

SEQ ID NO: 60871 - DNA, 633 bp, Homo sapiens
  misc_feature: GYAE6OF01EV61P.12.53.E09.1.454.CMB.1.raw
tcagatacgacgtacacgaccggtgctcgatttagagagagtgtgttgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcagacgcccccaaatcatgtatttttgatgtcactaatccggccctcgaggggttttctgatcgtcttctctggcctccaagtctgactacgaccggcctccctgaccatcctcgtcggcctccgaggtctggacggacgaggtctagatttattagttgcagtctactaatactaacaaggcaagcacgtccctacccttcgttttcggtccgtttacgggaacggttacgggaaccctaagggtccaacccgttaccgtaccgtccgtaacgaccccgaaacggcccccaaacccgtctcggttacctaccttccgttcccgttccccccgtccccttcccgttacccgttaccggttaccttacgttccgtagggaacggccggggtgtcgggaaccg

SEQ ID NO: 60872 - DNA, 585 bp, Homo sapiens
  misc_feature: GYAE6OF01A804P.12.53.E09.1.454.CMB.1.raw
  modified_base (263)..(263): a, c, t, g, unknown or other
  misc_feature (263)..(263): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataacttgtctctgtaccaacaacaccaggacaaacgccccaaatcatgattangaggcactaagccgccgtcgtaggggtttcttatcgtcttctcgtggtcctccggtagtccgtggaccaaccgaccggccctccctagacctaatcgtcgtcggctccgaggctggaggacgaggcggtattacttacgtgttgactctatagtggtacgggtagtagtcctacgtttcgattcgtctagtcggcgggtacggaccagtcctacggaccgtcgtcggtcacgaccgtacggcctccggcccctcggtccaccgttccgtaccgtccccctccctccctccgtacgttccgtacttcgtgggcggtcgggtcg

SEQ ID NO: 60873 - DNA, 537 bp, Homo sapiens
  misc_feature: GYAE6OF01ALNT4.12.53.E09.1.454.CMB.1.raw
  modified_base (271)..(271): a, c, t, g, unknown or other
  misc_feature (271)..(271): n is a, c, g, or t
  modified_base (330)..(330): a, c, t, g, unknown or other
  misc_feature (330)..(330): n is a, c, g, or t
  modified_base (505)..(505): a, c, t, g, unknown or other
  misc_feature (505)..(505): n is a, c, g, or t
  modified_base (529)..(529): a, c, t, g, unknown or other
  misc_feature (529)..(529): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggaccaaacgcccccaaatcatgatttangaggcactaagcggccctgtaggggtttctatcgcttctctggctcgagtctggcaacncggcctcctgacatcgtctgggcctcgaggctggaggacgagggcggtatttacttacgtgttcgctcatagtggcggtagtgctacttcgattcgtctagttcggcggaggaccaagctacgaccgtcgtcggcacgccacggcctccgccccgtgccacgtcctccgttcccnccctcctactccgtctactcgcgnggtcggcg

SEQ ID NO: 60874 - DNA, 407 bp, Homo sapiens
  misc_feature: GYAE6OF01B8AHJ.12.53.E09.1.454.CMB.1.raw
  modified_base (235)..(235): a, c, t, g, unknown or other
  misc_feature (235)..(235): n is a, c, g, or t
  modified_base (361)..(361): a, c, t, g, unknown or other
  misc_feature (361)..(361): n is a, c, g, or t
  modified_base (383)..(407): a, c, t, g, unknown or other
  misc_feature (383)..(407): n is a, c, g, or t
tcagatacgacgtacacgaccggtgctcgatttagagagagtgtgttgggacttataaccttgtctcctggtaccaacaacacccaggcaaagcccccaaactcatgattttatgagggcactaagcggccctcaggggtttcttatcgcttctctggctccgagtctggcaacacggcctccctgacaatctctgggctccaggctgaggacgaggcgattattactgttgctnatatgcgggtagtagcactttcgatgtcctattcggcggagggaccaagctgaccgtctggtcagcccaaggctcgccccctgcactctcgttcccaccctctctacgtcgtatctgacgcgggtntcggacgaaggcgacaagtagnnnnnnnnnnnnnnnnnnnnnnnnn

SEQ ID NO: 60875 - DNA, 699 bp, Homo sapiens
  misc_feature: GYAE6OF01E14BN.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgcaaccagcagtgacgttaatgaataatactatttctcctggtaccagccaacacccgaggaccaaacgccccaaactcatgtattatgaggcactaacgcggaccctcgtagggtttctactcgtcttctcgtcggcctcgagtcgtaggacaacgacgcctcctagacatctcgtggctccgaggctaggaggacggaggtacgtatttacgttacgttggttgactacgtattagttcgggacgggttagtacgtccttacgtttcgagtttcgttaccgttaggttaccgggcgggtaacgggtaccaacggtccgttaccgggtacccgttccggttacggggtacctaaccgggtacccgaaaccgggttcccgttacccccgggaccccccgtttaccgggttacccctaacccgttccccggtttacccggttaccccccctaccccgtttacccgtttacccggttacccggttaccggtttaccgttcggtcggtacccggggg

SEQ ID NO: 60876 - DNA, 565 bp, Homo sapiens
  misc_feature: GYAE6OF01BIK4E.12.53.E09.1.454.CMB.1.raw
  modified_base (288)..(288): a, c, t, g, unknown or other
  misc_feature (288)..(288): n is a, c, g, or t
  modified_base (507)..(507): a, c, t, g, unknown or other
  misc_feature (507)..(507): n is a, c, g, or t
  modified_base (526)..(526): a, c, t, g, unknown or other
  misc_feature (526)..(526): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgccccaaactcatgatttatgagggcactaagcgccctnaggggtttcttatcgcttctctggctccgagtctggcaacacggcctccctgacaatctcgtgggcctccgaggctaggaggacggagggcggtattattactgttgctctatatggcgggttagtagctactttcgatgtcctagttcgggcggacgggaccaaggctacgtacccgtcgtcgggtcacgcccgaggtcctcgcccccgtcggtaccnccgttccgtccgttccccnccctccctcgtaccgtcgtacttcgtcggcgcgggtccg

SEQ ID NO: 60877 - DNA, 608 bp, Homo sapiens
  misc_feature: GYAE6OF01A3FA3.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctggtaccaacaacacccaggcaaagcccccaaactcatgatttatgaggcactaagcggccctgagggtttctatcgcttctctggctccgagtctggcaacacggcctcctgacaatctctgggctcaggctgaggacgaggcggattattactgttgctacatatgcgggttagtagctacgtttcgagttcgtcctagttccggcgggacggtaccaagccgtaggacccgttccgtggggttaccacgggtaccccgaaggcccgttccggccccccgttcggtccctaaccgtttccgttccggtttcccccaccccgtttccccgtaccgtttacccggttccgttaacttcccgtacggtaccgggtccggggtccgg

SEQ ID NO: 60878 - DNA, 528 bp, Homo sapiens
  misc_feature: GYAE6OF01E3AJF.12.53.E09.1.454.CMB.1.raw
  modified_base (501)..(501): a, c, t, g, unknown or other
  misc_feature (501)..(501): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgctgggagtgataagtttgtctcctggtaccaacatcacccaggccaaagcccccagactcatgatttatgagggacaaaaacggccctcggggatttctaatcgcttctctggctccaagtctggcaacacggccctcctgacaatctctgggctccgaggctggaggacgaggtctgatttatactgctgctcatatgcaggtagtggcctactttcgctactacgttcgggaccggaagggaccaagtcttacgacccgttcctacgtccacgcccgaaggcctcgccccctggtccnctctctccccacctcnctcgtctntcg

SEQ ID NO: 60879 - DNA, 658 bp, Homo sapiens
  misc_feature: GYAE6OF01C83AR.12.53.E09.1.454.CMB.1.raw
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacaccaggacaaacgccccaaatcatgatttatgaggcaactaagccgcctcgtagggtttcttagtcgtcttctctggctccgagtctggcaacncgcctccngacatctctggctcagctggaggcgaggcggtatttatacgtgtcgtctctagtagtggacgggttagtacgtcttaccgtttacgagttcgttacctaggttccgggacgggtaacgggaacctaacggtccgttacggtaaccccgtttccggtacgggttccaacggtaccccgtaacggtcccgtacccggtcccccccgttcgggtacccttaacccgttcccgttacccggtttccccccgtcccctttaaccccgttcccgttaaccccggttccgttaacttccggtacggaccgggtccggggtacccgg

SEQ ID NO: 60880 - DNA, 638 bp, Homo sapiens
  misc_feature: GYAE6OF01D5RVT.12.53.E09.1.454.CMB.1.raw
  modified_base (437)..(437): a, c, t, g, unknown or other
  misc_feature (437)..(437): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaaccaccaggccaaacgcccccaaatcatagatttatgacgggcaacgtaagccggccctcgtacggggttttcttagtccgtctttcgtctgggcctccgtagtctcggactaacgaccggtccctcctagaacaactctcgtagggctccgagctgaggacggagcggtattattactggtgctacatcgtggcggtagancgtactttgattcgtactagttcgggacggtacggacctaagccgttcgaaccgttccgtagggttacgaccgtacccgaagggtccctaccggcccccgttcgggtacctaccgttccgtttcccggtccccccgtcccgtttcccgtacccgttacccggttccgttaacgttccggtaacggcgggtacccggggtcg

SEQ ID NO: 60881 - DNA, 977 bp, Homo sapiens
  misc_feature: GYAE6OF01EWRPB.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctcgccctgactcagcctgcctccgtgtcgtgggtctcctggacagtcgatcaccatcctcctgcacgtgggaccagcaggtgaatgcgtgggagtgtaattaacgtttcgtctcccgttaggaacccaaaacaacctacccgaacggaccaaaaccgcccccaaaacgtctaactgtaacttttagtcggaacggacaacgtaaacggccggtaccccgttaccgtagggggtttttaccttaacgttccggtcctttccgttcggtcgggtacccgttccgggtaacgttccgttacgggaacctaaaccgtacccgggtcccttcccgtaacggacctaaacgttccgttaccggtacgggtacccgtacccgacggggtacgttaacgggaacggggtaaccgggtaacgggaccggtttaaacgtttaccgttttaaacgttcgggtttacgtaccgttaaccgtaaacggtttaacggttgggggtaaaccggggtttaacggtaacggttaccgtttaaccgttttaacggtagtttaacccggtttaacccggtttaaggtttacccgggggaacgggggtaaccgggtaaaccccgttaaacgggtccccggtttaaccggttaacccccgggtttaccgggttaacggggttcccgaaacccggggtaccccgggtaaacggggtacccgttcccccggggtacccccggtttaccggtcccgttaaaccccgtttccccggtttaacccccggtttaccccccgtcccccggttttaaccccgttaaccccggtttacggggttacccttttaacccggtcgggttaacccgggtaacccgggggg

SEQ ID NO: 60882 - DNA, 581 bp, Homo sapiens
  misc_feature: GYAE6OF01BFDAG.12.53.E09.1.454.CMB.1.raw
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttangaggcactaacgcggcctcgagggtttcttancgtcttcnctggctcgngtctgcacacgcctcctgacatctctggctcgagctgaggacgaggcgtattattacgtgttcgtctctatatggtcgggtagtacgctacttcgattcgtctagtcggcggaggaccgaagctaccggaccgttccgtacggtcgacgccgaacggtccgtccggtcccccgtccggttccacccgttccgttacccggttccccgcccctttacccgtcccgtttaccgtccgttactccgttcgtcgggccgggtcggg

SEQ ID NO: 60883 - DNA, 632 bp, Homo sapiens
  misc_feature: GYAE6OF01ASS56.12.53.E09.1.454.CMB.1.raw
  modified_base (331)..(331): a, c, t, g, unknown or other
  misc_feature (331)..(331): n is a, c, g, or t
  modified_base (391)..(391): a, c, t, g, unknown or other
  misc_feature (391)..(391): n is a, c, g, or t
  modified_base (613)..(613): a, c, t, g, unknown or other
  misc_feature (613)..(613): n is a, c, g, or t
tcagatacgacgtacacgaccggtgctcgatttagagagagtgtgttgggtttgggggtcgtttgcctgggctctgctgctcctcactctcctcactcaggacacagggtcctgggcccagtctgccctgactcagcctgcctcgtgtctgggtctcctggacagtcgatcaccatctcctgcactgggaccagcagtgatgttggacttataaccttgtctctggtaccaacacacccaggtcaaacgcccctaactcactgtaatttatgagggcactaacggcggccctcgtaggggtttcttactcgtcgtctctggctaccgcgtntcggcaacgccgtcctccctgacaactctcgtgggcctcgacggtcaggtacggggacgnggacggtattacgtttacgtgttgtctcgtacttgtcgggtagggtagttagccttatttcccggtaattcggtaccttgttccgggacgggtacgggaccgtaacgctacgggtacccggtcgtcgggtcacggcccgtaggcccttccggtaccccgtccgttaccgcccggtttcctcccgtttcccctaccccctccgttaccctaccgttacgttcncctcggcggtcgggtccgg

SEQ ID NO: 60884 - DNA, 173 bp, Homo sapiens
  misc_feature: GYAE6OF01DF9K9.12.53.E09.1.454.CMB.1.raw
  modified_base (171)..(173): a, c, t, g, unknown or other
  misc_feature (171)..(173): n is a, c, g, or t
tcagatacgacgtacacgaccggtgctcgatttagagagagtgtgttgggttgggggaagaggaagactgacggtcccccaggagttcaggtgctgggcacagcggccctgggctgcctggtcaaggactacttcctacgtcgtatctgagcggctggcaaggcgcatagnnn

SEQ ID NO: 60885 - DNA, 637 bp, Homo sapiens
  misc_feature: GYAE6OF01D0TP4.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctggtctcctggacagtcgatcacatctcctgcagtggaccagcagtgatgttggacttataaccttgtctctagtaccaacaacaccagacaaacgcccaatcatgtattatgaggcactaacgcgacctcgtagggtttctagtcgtcttctcgtggcctcgagtctagacaacaccgtcctacctgaactaatcgtcgtacggtctaccgaggctggaacggacgaggtacgtaatttattacgttagttgcctataattaggacgggtacggtaagtacgtcttacgtttacgtaagttcgtccgttaggttcgggacggtaacgggaacctaagtcgtacggacccgttcggtcggtactacgacccgtaacggccgttcccgcccccgttacggtacctaacccggttccgttacccgtttacccctaccccttacccgttacgttacccgttacgtacttaccggtcggacgcgggtacccgg

SEQ ID NO: 60886 - DNA, 633 bp, Homo sapiens
  misc_feature: GYAE6OF01BZSCP.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctaggtaccaacaacacccaggacaaacgcccccaaatcatcgtatttatggagggcacgtaagccggccctcgtaggggtttcttatcgtcttctctggcctccgagtctggacaacgacggccctcctgactactctcgtgggctccgaggctaggacggacgaggcggtattagttcgtgttgcttacattagtgggtacgggtagtacgtctacgtttcgagttgtccttagttccgggacgggaacgggaccaaggtccgtacgtacccggttccgtagggtccacgacccgaacggccgtccggtacccccgtcggtaccctaccgttcccgttcccgttaccccctccccgttcccttacccgttaccgttcgttacttcggtcggtaccgggtcgggtaccgg

SEQ ID NO: 60887 - DNA, 838 bp, Homo sapiens
  misc_feature: GYAE6OF01CS46G.12.53.E09.1.454.CMB.1.raw
tcagatacgacgtacacgaccggtgctcgatttagagagagtgtgttgggtttgggggctttgcctggctctgctgctcctcactctcctcactcaggacacagggtcctgggcccagtctgccctgactcagcctgcctccgtgtctgggtctcctggacagtcgatcaccatcgtcctgcactgggaccagcgagtgatgttgggacttataaccttgtctcctgtaccaacaacaccaggcaaacgcccccaaatcatgtatttatggacgggcacgtaacgccggccctcgtacgggttttcttaagtccgctttcgtcgtcggccttccggagttcctcgggacctaaccgacccggtcccttcccgtaggaacctaacgttccgtacgttcgggggcccttccggtaacgggtccgttacgggaacggggaccgggtaacgggggtaccggttaacttttaacggtttaaccggttttcggggtttacggtacccttttacgtaacgtttaagggttaccgggttaacgggggtttaacgtttaaaccgggtaccctttaaacccggttttttaccggaaacgttttcccgggttacccgtttaacggtttccggggggaaccgggtttaacggggtaaccccgtaaagggtcccgttaccggggttaccccggttccggtttaccggggtacctaaccgggtacccgtaagggttccctcccggtccccccgttcgggtacctacccgtttccggttcccggttcccccgttccccttcccgttaccgttccggttaaccttcgccggttacggcggggtaccgggtccgg

SEQ ID NO: 60888 - DNA, 662 bp, Homo sapiens
  misc_feature: GYAE6OF01CWWKQ.12.53.E09.1.454.CMB.1.raw
tcagatacgacgtacacgaccggtgctcgatttagagagagtgtgttgggtttgggggctttgcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctctggtaacaacagcacccaggaccaaacgccccccaactcctgtatttatgacggtcaactatttccgacgttcctacgtaagttacttaactacgtccttctttacgttcgttacgtacgtacgtcgcgacacgccgtccctcgacactactcgtcgggtccgtcggcgtgtaggacgacgagtcgtagttattacttacgtcgtacttacgtacaacttaactaacgacgtaccttacctactaccgtttcggttacggttggttcgggttccgggtcggggaaccgtaacgcgttccgtaccgtacccgtacgtacgaccgaccaccggtacgtccgtccccgtcccgtactccgttacctcgttaccccgtccccttaccgtcctccgtcttacgtcgtcgacggtcggtaccggtgtaccggacgccggctaacg

SEQ ID NO: 60889 - DNA, 624 bp, Homo sapiens
  misc_feature: GYAE6OF01A48RU.12.53.E09.1.454.CMB.1.raw
  modified_base (334)..(334): a, c, t, g, unknown or other
  misc_feature (334)..(334): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagccggccctcgtagggtttcttatcgtcttctctggctccgagtctggcaacncggcctcctgacaatctctcgggcctccgaggctaggacgggacggagggtcggtattattactgttcgctctatagtggtcgggtagtagtctacgtttcgagttcgttaccttagttcgggcggtaaggaccgtaagcgtacggacccggtccgtcgggtaccgacgtcccgaacggccctccggtcccccgtcggtaccctaccgttcccgttcccgttcccccgtccccttcccgttacccttaccggttaccgttacgttccgttcgggacgggtcgggtaccgg

SEQ ID NO: 60890 - DNA, 647 bp, Homo sapiens
  misc_feature: GYAE6OF01D08I7.12.53.E09.1.454.CMB.1.raw
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (403)..(403): a, c, t, g, unknown or other
  misc_feature (403)..(403): n is a, c, g, or t
  modified_base (451)..(451): a, c, t, g, unknown or other
  misc_feature (451)..(451): n is a, c, g, or t
  modified_base (485)..(485): a, c, t, g, unknown or other
  misc_feature (485)..(485): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtcttgggtctcctggacagtcgatcaccatcctcctgcacgtgggaccagcagtgagtggttggacttataaccgtgtctccgtagtaccaacaaccacccgaggaccaaaccgtcccccaaatccagtntaattttagnggaggtacaacgtaacggccggtacccctcggtacggggttttacttacgtccggtcctttcgttccgcggtacctccgtagtcgtcgacaacccgcgtcctccctagacctattccngtacggcctcgaggctggaggtacgaggtggtattattacgtgtacgntactagtgtaggacggtatcggtcttcgttagtntttacgtccgttacgtcgggacgtaacggaccgagttccgacggtaccgtcgttacggtcgacgaccgtacgtccgccgttacccgcgttacgccgttcccgtaccgttccccctcccgttaccttacgtccgttaccgcgttacgtgggagggccggtcgg

SEQ ID NO: 60891 - DNA, 808 bp, Homo sapiens
  misc_feature: GYAE6OF01DKQ3W.12.53.E09.1.454.CMB.1.raw
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgattaagttgtctcctggtaaccaaacaacacccgaggaccaaacgacccccaaactcatgatttatgaggcactaagccgcctcgtaggggtttcttacgtcgtcttcgtcgtcggtcctccgtagtcgtcggtacaaaccgtacccggtcctccccgtacgaacctaaacttccgtccgttcgggccgttacccgacggtcgtacggaacgggaacggacgggtaccgggtaatttaacgtttaaccgttggttacgtccgtttacctaagttaggttcgggtacggggtttaaggtaacggttaccgttaccgtttttacggtactttccggtttacccgtttaacggtttccggggaccggggtaacggggtaacccgaaacgggtcccgtacgggtaaacccccggttccggttacggggtttaacccaacccgggaccccgtaaacgggtccccgttaccccgggtaccccccgtttcccggggttacccttaccccggttccccggtttccccggtttacccccccgtcccccgtttaccccgtttacccgttaaccggttcccgtttaacttcccggttggtaccccggggg

SEQ ID NO: 60892 - DNA, 913 bp, Homo sapiens
  misc_feature: GYAE6OF01C4PPI.12.53.E09.1.454.CMB.1.raw
tcagatacgacgtacacgaccggtgctcgatttagagagagtgtgttgggtttgggggctttgcctgggctctgctgctcctcactctcctcacctcgaggacacgacgggtccgtcgggcccagtctcgccctcgactcacgcctcgcctccgtgtcgtcgggtcctccgtggacagtacgatccacctactcctcctcgactacggtcgggaccagacgaggtgtagtggttacgggtacttaacttaaccgttcgtcctccgtacggtaaccaaacaaccaccgagaacaaccgaccccaaactctagtagttacttagtaggacggacaacgtaacggccgtccgtacggttacgggtttacttacgtccgttcttccgtcggtcggtaccgttccggtagttccgtacgggaccaaaccggtcccggtccccttacccgtacgaaacctaacttccgtcggtacggggtccctaccggacggtccgacgggtaacggggacgggaacgggtaccggttaagttttaaccgttacgtttcggtctacgttacgtaacgttcggtacggggttacgggttaacgtacgttaccgtttaccgtttacgtacggttaccgtttaccggttacgggttacccggggaacggggtaaccgggtaacctaacggggttccgttaacccgggtacccgggttaccgggttaccggggtaccgtaacccgggtaccccgtaacggggttcccccgtccccgggttacccccggtaccggttacccgttaccccgtttccccgggtttacccccgttttcccccccgttaccggtttaaccccggtttaccggtttacccggttaccggttacccggtacgggggacccggggttccgggtacccgggtaaaccgggg

SEQ ID NO: 60893 - DNA, 396 bp, Homo sapiens
  misc_feature: GYAE6OF01BMP47.12.53.E09.1.454.CMB.1.raw
  modified_base (263)..(263): a, c, t, g, unknown or other
  misc_feature (263)..(263): n is a, c, g, or t
  modified_base (382)..(382): a, c, t, g, unknown or other
  misc_feature (382)..(382): n is a, c, g, or t
  modified_base (388)..(396): a, c, t, g, unknown or other
  misc_feature (388)..(396): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttctgatcgcttctctggctccaagtctgactacacggcctccctgaccatctctgggctccgaggctggaggacgaggctgatttattagttgcagcttcatatacaagcagcagccaccctnttgtcttcggagtgggaccaaggtcaccgtcctacgtcagccccaaggcccaaccccatcgtcactctcgttccccgccctcctctaccgtctactcgtgacggcgggctggcaaggcncatagnnnnnnnnn

SEQ ID NO: 60894 - DNA, 536 bp, Homo sapiens
  misc_feature: GYAE6OF01CJ99A.12.53.E09.1.454.CMB.1.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (389)..(389): a, c, t, g, unknown or other
  misc_feature (389)..(389): n is a, c, g, or t
  modified_base (532)..(532): a, c, t, g, unknown or other
  misc_feature (532)..(532): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcggcctgcctccgtgtctgggtctcctggacagtcgatcaccatctcctgcactgggaccagcagtgatgttgggacttataaccttgtctcctggtaccaacaacacccaggcaaagccccaaatcatgatttangaggcactaagcggcctnaggggtttcttatcgcttctctggctccgagtctggacaacgacggcctccctgacaatctcgtgggctccaggctggagacgagcgattatactgtgctcatntgcgggtagtagctactttcgattgtcctagttcggcggtacggacaacgcgtcgaccgtccgtgggtcacgcccgaaggcctccgcccctcggtccactcgtccgttcccgcccttctccgtacgtcgtactctgagcgggntcgg

SEQ ID NO: 60895 - DNA, 797 bp, Homo sapiens
  misc_feature: GYAE6OF01DU64M.12.53.E09.1.454.CMB.1.raw
  modified_base (286)..(286): a, c, t, g, unknown or other
  misc_feature (286)..(286): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctcgcctccgtgtctgggtctccgtggacagtcgatcacactctcctgcacgtgggaccagcagtgagttggttacggtactttaataaccttcgtctcgtacgtaaccaaacaaccaccaggaccaaacgaccccaatcatagtattagnggacgacacacgccgtcctacggtagggtttcttagtcgtcttctacgtcgtccgtcgtacgtcgtacgaccaacgtacccggtcctaccgtagtaacctaacgttccgtacggttaccggtccgtaccggtacggtacgtaacgggacgggtacggtaaaaaacggtcgttaacttaactttaaccggttacgttcgtccgttacgtaccgttaacgtaaggttaacgggttaaggttaaggtttaacgtacggttacggttacgggttttacggggtaccgggttacggggtaccgggaaaccgggtaacgttaaacgggtaccggtaaccgttaaccggtaaccggtaccgtaaccggaccggtaaccggtccgtacccgtccccggttaccgtaccgtacccgttacccgttaccccgttaccccgttacccttacccggttacccgttacggttaccgtacggttcggttaaccggccggggtacgggtcggtaccgggtaaccgg

SEQ ID NO: 60896 - DNA, 631 bp, Homo sapiens
  misc_feature: GYAE6OF01DCJLU.12.53.E09.1.454.CMB.1.raw
  modified_base (268)..(268): a, c, t, g, unknown or other
  misc_feature (268)..(268): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (592)..(592): a, c, t, g, unknown or other
  misc_feature (592)..(592): n is a, c, g, or t
  modified_base (602)..(602): a, c, t, g, unknown or other
  misc_feature (602)..(602): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcacgtgggaccagcagtgagtgttggacttataccttgtctctgtacaacaacaccaggacaaacgccccaaatcatagtatttagngaggacaacgtaacgccggcctacggtacgggttttctatcgtcttctcgtcgctccgagtctaggcaacgccggacctccngaacatcgtcgnggcctcgagcgtggaaggcgaggcgtattacgttacgttcggttgacctcgaagttacggtcgggacgggtttagtaacgtaccttaacgtttcgtagttccgttcgtaacggttccgggacggtacggacctaagccgttacgaccgtcgtgggtaccacggaccgagtcccgtcccgtaccccgtggtacctccgtccgttccccttaccccgacccttacccggttnttacccggtnttacctcggtcggacgggtccggtaccgg

SEQ ID NO: 60897 - DNA, 782 bp, Homo sapiens
  misc_feature: GYAE6OF01D290Q.12.53.E09.1.454.CMB.1.raw
  modified_base (769)..(769): a, c, t, g, unknown or other
  misc_feature (769)..(769): n is a, c, g, or t
  modified_base (776)..(776): a, c, t, g, unknown or other
  misc_feature (776)..(776): n is a, c, g, or t
tcagatacgacgtacacgaccggtgctcgatttagagagagtgtgttgggtttgggggctttgcctgggctctgctgctcctcactctcctcactcaggacacaggtcctgggcccagtctgccctgactcagcctgcctccgtgtcgtggtactcctggacagtcgatcaccatctcctgcacgtcgggaccagcgtagtggagtggttacgggtactttaacttaaccgttcgtcctaccgtacggtaaccaaaccaaccgacccgaacggaccaaaccgacccccaaaactcgattagtagttttagacggacggacacgtaacggccggtcctcggtagggtttcttacgtcgtcttccgtacgtcggtccgtcgtacgtcgttacggactaaccgtaccggtcccttcccgtagtaaccgtaacgtccgttcggtaccgggtacctccggtaacgggtccgttaacgggtacgggaaaccgggtacgggtaaccgggttaacttttaaccggtttaacgtttcgggttacgtacgtttaacggttacgttaaagggttccgggaaacggggtttactaacgggtccttaacgggtttacggactttaccggtactttaccggggtaccgggacggtaacgggaccttaacggtcgtaccggtccggtccggtacggtacctaccgacccgggtacgtccctaccccggccttacgggtactcccgtacgtccgtaccccgtcctcgtactcggtactctacggngaccggnggtacc

SEQ ID NO: 60898 - DNA, 882 bp, Homo sapiens
  misc_feature: GYAE6OF01DHNB7.12.53.E09.1.454.CMB.1.raw
  modified_base (810)..(810): a, c, t, g, unknown or other
  misc_feature (810)..(810): n is a, c, g, or t
tcagatacgacgtacacgaccggtgctcgatttagagagagtgtgttgggtttgggggctttgcctgggctctgctgctcctcactctcctcactcaggacacgagggtccgtgggcccagtctcgccctgactcacgcctcgcctccgtgtcgtggtctccgtggacagtcgatccacctactcctccgtgccgacgtcgggaccagtcgtaagtggtagttcggttacggtaactttaacttaaccgttcgtccttaccgtacgaaacccaaacaaaccaccgaacgaaccaaaccgacccctaaatcagttagtattagaggaggacctaacgtaacggccggtaccgtcggttacgggtttcttaacgtccttcttccgtcgtacggtcccgtcgtacgttccgtacggaacctaacccggacccggttccctaccgtacgaacctaacgttcgtcgggtccggactccggacggtacgacgggaggtaacggtacgggtaacgtttaacgtttagtttacgtcggttcgtacctaagttacgtaggggtacggttaacgggttaagtaccgggttactttaaccggtttacgtaccttttacggttacccggtttaacgggtacccgggggaaccgggtaaaccgggtaaccgtaacccgggttccgggttaccgttaccccgggtaaccgggttcggttaaccccggaaaccgtacccggggtacccgtacccccggttcccgggtacccccgttacccggtaccgtttaccccgttccccgttaccccccggtttaacccccnccccgtttaccccggttaccgtttaccggaccgtttaccggtccgtcgggaacccggggttcggtacccggg

SEQ ID NO: 60899 - DNA, 878 bp, Homo sapiens
  misc_feature: GYAE6OF01E44BL.12.53.E09.1.454.CMB.1.raw
  modified_base (544)..(544): a, c, t, g, unknown or other
  misc_feature (544)..(544): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatcctcctgcacgtgggaccagcaggtgagttggttacgggactttaacgttaaccgtttgtcctcccgtaggtaacccaaaccaaccgacccgaggacccaaaaccgaccccccaaaactcctaatacgtaattttagtaggaacgggaccaacgtaaccggccggtccccgttacggttacggggttttccttacgtccggttcctttccgttccgttcgggtacccgttacccgggtaggttccggttaccggacctaaacccggtacccgggttcccccgttacccgtacggaaccccttacgttcccgttccgggttacccggggtccctacccggtacgggtccgtacgggaacggggtaaccgngggtaccttagttaagttttaacgttacgtttcggacctaagtccccttaagaacttaaacgttaacgaaacgtcgtaacgactacccgtacccttaaccccgtttcgtttacggtaccggttacgggaacgggtacgggtaacccgttaacgggccccgttaacccgttaccgtacccggtacccgtaacccggaaccccgtaaacccggtacccctaaacccccgtacgttaccccgtacgtaccccgtttacccgtccccgttccccccggccctttaccccgttaccgttaccgttaccggttagttccggtaggggtccggtcccgggg

SEQ ID NO: 60900 - DNA, 601 bp, Homo sapiens
  misc_feature: GYAE6OF01EARPZ.12.53.E09.1.454.CMB.1.raw
  modified_base (264)..(264): a, c, t, g, unknown or other
  misc_feature (264)..(264): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctctgtaccaacaacaccaggcaaacgccccaaatcatgatttangaggcactaagccgcctcgagggtttctagtcgcttcgtctggcctccgagtctggacaacacggtccctcctgacaatcgtcgtcggctcgaggctggacggacgaggcggtaatttacgttacgttgttcgactctatagtggacgggttagtacgtctactttcgagttcgtccgtagttccgggcggaacggaccaaggtcgtacggtacccgtcgttgggtaccacgacccgtaacggcctacccggtcccccgtgtccgtaccgtccgttcccgttcccctaccccttccgtaccgttaccgtcgttactcggtcgacgggtccggtacgg

SEQ ID NO: 60901 - DNA, 743 bp, Homo sapiens
  misc_feature: GYAE6OF01BB8P5.12.53.E09.1.454.CMB.1.raw
  modified_base (269)..(269): a, c, t, g, unknown or other
  misc_feature (269)..(269): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtcgtgggtctccgtaggacagtcgactcacctatcctcctgcacgtacgggaccaggcaggtgagtgtaggtacttatacttgtctacctgtaaccaacacaccaggacaaccgaccccaaancatagtatttacgaggaggactaacgtaacggccgtccgtacggttaacgggtttcttacgtccgtcgtttcctcgtacggtccgtaccggtacgtacgtacggacaaaccggtccgtcccctcgtacaaccgtaactccgtcgtcgggacctccgtaggacgtggacggtaaccggaggtaggttaactttagtttacgttggtttgttacgaagttaggtacggtacgggttaagtcggtacctttacgtttacgacgtttacgtaccgttacggttaccgggacggtaacgggaacccgttacgtacggtcccgttaacccgggccggttaccgacggttacccggaacgtccgtcccccggttaccccgtcggtaccacccggtttccctacccggttccccttaccctacggttccctacgttaccgttacgtcggtacggaccgggtccggtccggtagaaccccggg

SEQ ID NO: 60902 - DNA, 783 bp, Homo sapiens
  misc_feature: GYAE6OF01C2FHV.12.53.E09.1.454.CMB.1.raw
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
tcagatacgacgtacacgaccggtgctcgatttagagagagtgtgttgggtttgggggcgtttgcctgggctctgctgctcctcactctcctcactcaggacacagggtcctgggcccagtctgccctgactcagcctgcctccgtgtctgggtctcctggacagtcgatcaccatctcctgcacgtgggaccagcagtgatgttggacttataaccttgtctctgtaccaacacaccagacaacgccccaancatgtattangaggacactagcgcctcgtacgggtttcttacgtcgtcttccgtcgtcggacctccggtagtcgtcggacaaccgaccggcccttcccgtagacctaagttccgtcgtcgggtcctaccgaggacgtacggacgggaccggacgggtacggtaacgttttaacgttacgtttcgggtttactcccttaccgtaagttacggtacggggtacggggtttaacgtacgtacccgtttaccgttttcggaatttccggttaccctaagggtttccggggaacgggtacggggaaacctaacgggtcgttaccgggtaaccccggttccggttacggggtaccaaccccggtacccggaagggtccccgttacccccggtccccccggttacgggttaaccctcccggtttaccccggtttccccgtttacccccccggtaaccccctttccccgttacccgggtttacccgttccggtttaacgttccccggttaggggacccgggtcccggggttaaccggg

SEQ ID NO: 60903 - DNA, 815 bp, Homo sapiens
  misc_feature: GYAE6OF01C7A4M.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctcgcctccgtgtctgggtctcctggacagtcgatcaccatctcctgcacgtgggaccagcagtgagtggttggtacttagtaacctttgtcttcgtcggtaaccaacaaccaccgaggaccaaacgaccccaaactcattagtattagtcgaggcaacgtaacggccggtaccctacggtaggggttttctacgtcgtctttctcgtcggcctccgtagtccgtacggaccaaaccgccggtaccccttaccgacggaacctaacgtttccgttacggtcggggtacccttaccgggaacgggtacccgtaaggggaaccggggacgggtaacggggtaccggtttaagttttaacgtttaccgtttggttacgtccttacgtaagtaggttacgggacggggtttaacgtacggttaaccgtttacgtttacggtacgtttacgttacccgttaaggtttacccgggggaacgggtaaaccggggtaacctaaacggtccggttacccggtaaccccgggttaccgggtcggggttaacccgacggtacccccggtaacgggtccccgttaccccggtccccccggttacgggtccctaaccgttccggtttccccgtacccccggtccctttacccgtcgttaccgttcgttaacgtccgtgggcggtcgggtacgg

SEQ ID NO: 60904 - DNA, 969 bp, Homo sapiens
  misc_feature: GYAE6OF01BTPLH.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctcgtgtcgtgggtctccgtggacagtcgatcaccatctcctgcacgtcgggaccagctagtcgtagttggttcgggtactttaacttaaccttgttcctcccgtacggtaaccaaaccgaaccacccgacggaaccaaaccgaccccaaactcctaatagtaattagaggacggacaacgtacgcccggtccgttacggttaacggggttcttacgtccgttccgtttaccgtcgtcggtccgtaccggtagtccggtacggtacctaaacccggtcccggtaccccttacccgtacaaaccgtaccgttccggttaccggtcgggtcccttaaccggacgggtaccgtagggaaccgggaacggtacgggttacgttaattttacgttacggtttcgtttaccgacttacggtaagttacggtacggggttacgggttaacgtacggttacccgtttaacgtttaccgggtacttttacccgggttaccgttttaacggggtcccgggggtaaccgggtaacccgggaaaccgttaacccggtcccggttaaccccggggttaccccgggttaccgggttacccggggtaacccgtacccggggtaaccccggttaaccggggtccccccgtttaacccccgggttccccccgggtttacgggttaaccccccgttttaaccccggttccccgggtttttccccccgggtaaccccccccggtttccccgtttacccccggtttaacccgggtttaacccggtttccccggttttaaacgggccccgggttaaaccgggggtccggggttccccgggggtaacccggg

SEQ ID NO: 60905 - DNA, 870 bp, Homo sapiens
  misc_feature: GYAE6OF01DC4DB.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtcctgccctgactcagcctgcctccgtgtctgggtctccgtgacagtcgatcaccatcctcctgcacgtgggaccagcagtgatggttaggacttactaaccttgtcctcctagtaccaacaaccacccgaggaccaaaccgacccccaaatcatagtatttagtaggacggacaacgtaacggcccggtcccgttacggtacggggttttcttacgttcctcgtttcctcggtcggtccgtccgtagtccgtacggaccaaaccgcccggtaccctacccgtagtaaacctaaccgttccgtcccggtcggggtcccttaccgacgggttacggtacggggaacggggaccggtaacgggtacgggttaaactttttaacgttaccgttggtttaccgtactaccgttaaggtttacggtcggggttaacggggttactaacggttaacccgtttaccggttttacgtaacgtttccggtttacccggtaacgggtttaccgggggaaccggggttacgggaaaccgttacgggttaccgtaccccgggtacccgttcccgggttagggtacccgaacccgggttcccgaaccgggttccccgtacccccggtccccccggttacccgggttacccacccggtttttcccggtacccccggtttcccccccgtccccgtttacccccgtaggtttacccccgtttacgggttacccttcgggtaacgggtccgggtcccggggtaaccgg

SEQ ID NO: 60906 - DNA, 432 bp, Homo sapiens
  misc_feature: GYAE6OF01B3VOY.12.53.E09.1.454.CMB.1.raw
  modified_base (388)..(388): a, c, t, g, unknown or other
  misc_feature (388)..(388): n is a, c, g, or t
  modified_base (411)..(432): a, c, t, g, unknown or other
  misc_feature (411)..(432): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcgtaggggtttcttatcgcttctctggctccgagtctggcaacacggcctccctgacatctcgtgggctccaggctggagggacgaggcgtattattactgtgcagcagtgggatgacagctagtagtcgggtcggtagttcgggacggaggacagctggaccgtcgtaggcacggccaacggtctccgccccgtcgcctacttcttccgtaccctaccctcctacgtcgttcgtacctgtcggtacggccgggtnacgggacacggacgcgagtacgnnnnnnnnnnnnnnnnnnnnnn

SEQ ID NO: 60907 - DNA, 1149 bp, Homo sapiens
  misc_feature: GYAE6OF01DSGC4.12.53.E09.1.454.CMB.1.raw
tcagatacgacgtacacgaccggtgctcgatttagagagagtgtgttgggtttgggggctttgcctgggctctgctgctcctcactctcctcactcaaggacacgacggggtcctgggcccagttctcggccctgacctcacgcctcgccgtcgtgtcgtcggttcctccgtggactagtcgactacaccgtactcctcctgacacgtcgggaccagcgtagtcgtagttcggttacggtaactttaacgttaaccgtttggtaccgttaccgtacggtaaaacccaaaccgaacccgtaacccgagggtaaacccctaaaaccggaccccctaaaacttaccgtaagttacgttaacgttttaacgacgggtaaccgggtaacctaaccggtaacgggtaccccggttaccgggtttaaccggttaacggggttttttacccttacgttaccgttaccgtttcccgttcggtaccgggtttcccgtaaccgggttcggttaccggttaacggtaaccccggaaacccggtttacccgggtaccccttaaccgttaacggtaaaacccttagtttaccccggttaccggggtccggtacccggtaccgggtttaaacgggtccggttaaacggggtaaacccgggtaaccggggtaaacggttaaccgggttttaactttaacgggttttaaccggttcggtttaccgaacccgttaaggtaaccggtttagggtaacggggttaaacccggggtttactaaccgggttccttttaacccggtttaaggttaccccggttaacggttttaccccgggttacggggttaaccgggggtaaccgggttaacggtaacccggttaacgttacccggggtttaaccccggtccgggttaccccggggttaaaccggcccggttaaaacccgggtcccggtttaaccccgggaccccggtttacccccgtacccgggttaccccggtttacgtacccccggtttttcccccggtttaacccggttttccccccggtaaacccctttttaacccgggacccggggttttttaaaccccctttagggggtttaacccccgtttaacccgggggggtacccgggtttaaaaccgggccccccgggggttttaaacgg

SEQ ID NO: 60908 - DNA, 763 bp, Homo sapiens
  misc_feature: GYAE6OF01CE16K.12.53.E09.1.454.CMB.1.raw
  modified_base (469)..(469): a, c, t, g, unknown or other
  misc_feature (469)..(469): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcacgtgggaccagcagtgagttggttggtacttataaccttgtctcctaggtaaccaacaaccaccaggacaaacgaccccaaatcatagtatttagtaggaacggacaacgtaacggccgtccgtacggtagggtttcttacgtccgtccttctcgtcggtcctaccgtgtcgtcggaccaaccgtaccggtccctaccgtagaacctaacgtccgtcgtcgggaccctcggacggcgtagaaccggggtacggaggtacggttaacgtttattaccgttgttccgntactagtagttcggggtaggtaacgtacgtaccttacgtttccgtaagttccgttaccgttacggtacggggaccgggtaacgggtaacccgtaacggtcggttacccgggtacccggttacgggttaccgggtaccgtacccgggaaccccgtaacgggtcccgtccccgggtacccccggttccgttaccgtaccccgtttcccgttaccccggttaccccccttaccccggttccccttaaccgggtaccgtttacgtacgttacccggtacggggccggtcgggtaccgg

SEQ ID NO: 60909 - DNA, 884 bp, Homo sapiens
  misc_feature: GYAE6OF01ARMHH.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtcgtgggtctcctggacagtcgatcaccatctcctgcacgtcgggaccagcaggtgagttggttagggtacttacttaaccttcgtcttcccgtaggtaaccaacaaccacccgaacgggaccaaaccgaccccctaaactcacttagtatttagtaggagggactaacgtaacggccggtacccgttacggttacggggtttacttacgtccggtccttctcgttcggccgttccgtagttccgtaggaccaaaccgtcccggtcccctacccgtacgaactaacgttccgtcggtacgtaccctccgaacgtaccggtaggacgggaccggaggtaccgtaacttacgtacctacgtcgtattacggacaacgaacggaaccgtaaacgggtccgtacccgttaacgggtttcggggtaccgggttaccgggaccggggtaacccgggtaaacctaaacccggtttaccggtaaccccgggttaccggtaacccggtacccggtaacccggtaccccggtaaaccggggttcccccgttaccccgggtaccccccgttacccgggttacccttaacccccggttccccgtttccccggtttaccccccccggtacccccggttttccccgttacccgggttaaccccggtttaccggttaccggttacccgggttggggtaaaccccgggttccgggtaccggtttaacccggggaccgtaacggggtaaccccgg

SEQ ID NO: 60910 - DNA, 710 bp, Homo sapiens
  misc_feature: GYAE6OF01BZ2SJ.12.53.E09.1.454.CMB.1.raw
  modified_base (270)..(270): a, c, t, g, unknown or other
  misc_feature (270)..(270): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctccgtggacagtcgatcaccatctcctgcactgggaccagcagtgatggttggacttataaccttgtctcctaggtaccaacaacacccagacaaacgccccaactcatgatttangaggcaacgtacgccggccctcggtagggtttcttacgtcgtcttctcgtcggcgtcggactcgtggccaacgaccggcctccgagactaactccgtcgtcggcctaccgaggccgtaggacgggacgggagggtaccggtaatttaactttacgttgtttcgactactagttacggtgggttacggggttacgtacgtaccgtacgtttagtacgttcggttaccgttagttccgggacggggacggtaacccgaggtccgtacggtaccccggtacgggttacggacccgtacggacccgtacggtcccggtcccggtacccccggttccggtacccgtaccgttcccgtttccccgtttaccccccgccccgtttcccctaacccggtttacccgttaccggttaccgttcgacggtaccggggtcgggtacccggg

SEQ ID NO: 60911 - DNA, 711 bp, Homo sapiens
  misc_feature: GYAE6OF01BKI7U.12.53.E09.1.454.CMB.1.raw
  modified_base (146)..(146): a, c, t, g, unknown or other
  misc_feature (146)..(146): n is a, c, g, or t
  modified_base (353)..(353): a, c, t, g, unknown or other
  misc_feature (353)..(353): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtntctgggtctcctggcagtcgatcaccatctcctgcacgtgggaccagcagtgatgttggacttataccttgtctcctaggtaccaacacacccaggacaaacgccccaaactcatgtatttatgaggcacgtaacggcgcctcgtacgggtttcttactacgtcttctctcggtactccgtagtcgtcgacaacgaccggccttccncgactactctcgtaggcctcgaggtctggaggacggaggtacggtatttacgttacgttgttacgcttaccgagttagtacggtacgggttaaggtaacggtaccttaccgttttacgtagttacggttaccccgtttaggtacccgggaccgggtaacggggtacccgaaacggttcgttacccgggtaacccgtcccgggttacgggtccgtaaccggtacccgggaacgtcccgtacccggtccccgttccgggtaccttacccgtttcccgttacccgttacccccttaacccttcccgttaccttacccggttactttaccggtaccgtacggtaagggtcccgggtaccggg

SEQ ID NO: 60912 - DNA, 566 bp, Homo sapiens
  misc_feature: GYAE6OF01DBZKL.12.53.E09.1.454.CMB.1.raw
  modified_base (282)..(282): a, c, t, g, unknown or other
  misc_feature (282)..(282): n is a, c, g, or t
  modified_base (401)..(401): a, c, t, g, unknown or other
  misc_feature (401)..(401): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctctgtaccaacaacaccagcaaagccccaaactcatgattatgaggcactaagcggccctnaggggtttcttatcgtcttctctcggctccgtagtcctggcaaacacggcctccctgacaactctcgtcgggctccgaaggctgaggacgaggcggtattattacgtgttgctcatagngcggttagtagtctacgtttcgattcgtctagttcggcggaacggtaccaaggctagtacccggtcctgggtcacgacccaaggcctcgacccccgtcggtcctactccttacgttccccaaccctcccgttctaccgttcgttaacncttcgngtcgggtaccg

SEQ ID NO: 60913 - DNA, 767 bp, Homo sapiens
  misc_feature: GYAE6OF01EHWMF.12.53.E09.1.454.CMB.1.raw
  modified_base (183)..(183): a, c, t, g, unknown or other
  misc_feature (183)..(183): n is a, c, g, or t
  modified_base (433)..(433): a, c, t, g, unknown or other
  misc_feature (433)..(433): n is a, c, g, or t
tcagatacgacgtacacgaccggtgctcgatttagagagagtgtgttgggtttggggctttgcctgggctctgctgctcctcactctcctcactcaggacacgacgggtcctgggcccagtctcgccctgactcacgcctcgcctccgtgtcgtggtcctccgtggacagtcgactccacctntcctcctgcctacgtcggaccagcgaggtgtagttggttacggtaactttacttacgttgtacctccgtacgaacccaaacaccgaccgtaacggaaccaaaccgacccctaaatcagttagttattacgaggacggacaacgtaccggccgtcccgttaggttacggtttctactcgtcttcgtcgcgtcctcgtagtcgtacgacccaacgccgtcctaccagaactacgtcgtcggtacgctaccgngtcgaggacgggtacgacggtacgttaacttacgttcgttggtactatacgttagaggttaccggtaaggttaacgtacgttaccttaacgtttcggtacgtttaccgttaccgtttacggggaaccggggtccggaaaccggtaaccgtaacgtccggtttaacccggccggtttacggacgggttaccaacccggtaccggtaccgttcccgtacccgtccccggttacggtacccttaccggtcccttccccggaacccctttccggttacccgttacgggttaaccctttcccgggtattacccggggtcggcccggaggggtttacccg

SEQ ID NO: 60914 - DNA, 980 bp, Homo sapiens
  misc_feature: GYAE6OF01DSG3L.12.53.E09.1.454.CMB.1.raw
tcagatacgacgtacacgaccggtgctcgatttagagagagtgtgttgggtttgggggctttgcctgggctctgctgctcctcactctcctcactcaggacacagggtccgtgggcccagtcctcgccctgactcacgcctcgtccctccgtgtcgtcgggtcctccgtaggactagtcgactccaacctactcctcctgccgtacggtacggaccagcgagtgtagttggttacggtaactttacttaaccttcgtcctcgtacgtaaccaaccaaccaccgagaccctaaccgacccctaaatctatagtacttagaggacgacaacgtacggccgtccgtggttacggtttcttactccggtacttcgtcgtacggcccgtcgtagtccgtacgaccaaacccgtcccggtaccttaccgtacgtaaaccttaccggttccgttacccgggtacgggtacccctacggggtacggtaccggttaacggggaaccgggaaacggggttacgggttaacggttttaaaccgtttttaacggtttcccggtagtttccggtaaccgtttacgtaaacggtttcgggttaaaccgggggttacgggtttaacggttacccgtttaaccgttaaccggttttaccggttaaacggttttcccgggttttaaacccgggtttcccgggggttaaacccggggtacggggttaaaacccggggtaacccggttaaccggttaccccggggtttaaaccccggttcccgggttaccccggggttaaccgggtaccccgtaaccggtaacccccggtaccggttcccccgggacccccggttaccccggttcccggttaccccgtttaaccccgtttccccggtttaccccccgttacccccggtttccccgttaccccggtttaccggttacccgggttaccttacccgggttgggtaaccggggtccggcccgggttaccgggg

SEQ ID NO: 60915 - DNA, 656 bp, Homo sapiens
  misc_feature: GYAE6OF01B740U.12.53.E09.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagatacgacgtacacgaccggtgctcgatttagagagagtgtgttgggtttgggggcgtttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacaccaggcaaacgccccaaatcatgtatttatgaggcactaagcggcctctaggggttctatcgcttntctgctcgagtctgacaacncggcctcctgactatcgtctcgggactcgaggtcgtaggaggaccgaggtcggtaatttagtttaacttggtttacgacttactaagttagtgggtcggggttaagttaggccttacgtttaccgagtttcggttaccgttaagtttccggggacggggaacgggaaccctaaggtccgtacggaacccggtcgttacggggtacctacggacccgaacggtccctccggacccccgttcgggtacctaccgtccgtttcccggttaccccaccccctttccgttaccgttaccggttaccgttacttaccggtggtacggccgggttcgg

SEQ ID NO: 60916 - DNA, 731 bp, Homo sapiens
  misc_feature: GYAE6OF01DPRZF.12.53.E09.1.454.CMB.1.raw
  modified_base (268)..(268): a, c, t, g, unknown or other
  misc_feature (268)..(268): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctgtaccaacaacacccaggacaaagccccaaatcatgactttangaggcaactaagcggcctcgtacgggggtttcttatccgtacttcgtctacggctccgagtctggtcaacaccggtcctcccgtagactaactcgtacgttgggacctccgaggctggaaggacgaaggcggtatttattaaccgtgttcgactactaagtagtggacgggttaagtaacgtacctacgttttcgaagtttcgtacccgttagtttccggggacgggtaacgggtaacccgtaaggtccgttacgggtaacccggttccggttacggggttaccaaccggtaccccgtaaacgggtcccgttaacccggtcccccccgttaccgggttacccgaaacccgtttcccgttaccccgggttttaccccccaaccccccgttttccccgttacccgttaaaccccggtttcggttaaaccttccgttacgggaccggggttccggggtaacccggg

SEQ ID NO: 60917 - DNA, 619 bp, Homo sapiens
  misc_feature: GYAE6OF01EMQU8.12.53.E09.1.454.CMB.1.raw
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
  modified_base (380)..(380): a, c, t, g, unknown or other
  misc_feature (380)..(380): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcgtggacagtcgatcacatctcctgcactggaccagcagtgagtgttggtacttataaccttgtctcctacgtaaccaacaaccaccagacaaaccgaccccaactcatagtatttagngaggacaacgtacgccgcctcgtacgggtttcttacgtcgtcttcgtcgtggtccgtcgngtcgtcgacgacaccgtcctcctagacctactctcgtcggctccgngcgtagaggacgacggacgtattattacgtgtagtctanagttgtacggnggtaagtcgacttacttacgagttcgtacgtgttccggggaggaacggtacacgcgttacgccgtcggtcggcaccgaccgacgtcctcccgcccgtttccgacgtcccgttaccgttccccggttacccgtcccctttacccgtacccgttacgttccgtacgttcgcggtcgggtcccggtaacggg

SEQ ID NO: 60918 - DNA, 750 bp, Homo sapiens
  misc_feature: GYAE6OF01B3OZI.12.53.E09.1.454.CMB.1.raw
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
tcagatacgacgtacacgaccggtgctcgatttagagagagtgtgttgggtttgggggctttgcctgggctctgctgctcctcactctcctcactcaggacacagggtcctgggcccagtctcgccctgactcagcctgcctccgtgtctgggtctccgtggacagtcgatcaccgtctctgcagtggacagtatgtatttaggaatttgacctgtctcctaggtaccaacaacgtacccgganaaacgtcccaagttaatctaatttagnggaggacacgtaacgccggcctagtaggtatttctacgacttcgtcttcgtcgtcggactaccgaggtcgtcgggaccgccgggtccttaccgataacctaatcgttcggtccgggacctaccggaggtacgtacggaacgggacgtacggacttaacttaacttaccgttacgtcggtcgtacgtactacggtaagttaggttaagggttaaggtttagtaaccgtacggtttaacgggtttcggggttaccgggtttaccgggacggggaaaccggtaaccggtaaacgggtaccgtaacccggttaactaacggtaaccgaccggaaccggtccgtacccgtccccggtaccccgttacgggtaccctaccgtttccgttcccgggttcccctcccccgttacgtaccgttaccggttacgttacggttaccgcgggtaccggccgggtacggtccggaaggtacggcgtactagg

SEQ ID NO: 60919 - DNA, 745 bp, Homo sapiens
  misc_feature: GYAE6OF01DYF2P.12.53.E09.1.454.CMB.1.raw
tcagatacgacgtacacgaccggtgctcgatttagagagagtgtgttgggtttgggggctttgcctgggctctgctgctcctcactctcctcactcaggacacagggtccctgggcccagtcctcgccctgactcagcctgcctccgtgtctgggtctcctggacagtcgatccaccatcctcctgcacgtcgggaccagcgagtagtgtggttacggtactttattaaccttgtcctccgtacggtaacccaacaaccacccgaggaccaaaccgaccccaaatctatagtattagcggacggacacgtaacggccgtccgttacggtacgggtttctagtccgtactttacgtcgtcggccgtcgacgtcgtacgactaaccgtaccggtccctccgtagacctacttcgtcgtcggcctacgagcgagacggacggaggtacgtaattacgttacgtgttcacgttactagttacggtacggggtaacggttaagtaccgtacgttaccgtttagtactttcggttaccgtttacggtaccggggtacgggaaccggtaactcggttaccgtacccggtaccggttacgggtacggtacgacccggtaaccgtacccggtccgttcccccggacccgttaccggtacctaccgtttccccggtacccttaccccccgtcccgttaccgttaccgttacccggttacgttacgttccggtacgggccgggtccgggtaaccgg

SEQ ID NO: 60920 - DNA, 764 bp, Homo sapiens
  misc_feature: GYAE6OF01A7P4H.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctcgcctccgtgtcgtgggtctccgtggacagtcgatcaccatcctcctgcacgtcgggaccagcagtgagttggttacgggtaactttacttaccttcgttccttacccgtacggtaacccaaccaaacccacccgaacggaaccaaaaccgaccccctaaactctaatgttaatttaggacgggaacggacctaacgtaacccggtccggtaccccgttacgggttacgggttttccttacgttccgttcctttccgcgttacggccgttaccggtacgttcgtaccgaccgaacccgtacccggtcccctacccataaccgtaacgttccgtcggttacggcctacggacggtcggtacgggaacgggtacggtagggtaaccgttagtttaacgtttcggttgttaacgtcttaacgtgttagtccggggttagtactacggtcctttacgttcgaacgtttcgccgttacgggcggaacgggtacgaacctcggtacgtaccgttaccggcggtacgccgacgacccgtcggcccgtccctcccggtcgtccttccgtccccgttacccttccccgttacttcccgttacgtaccggttacgacggtcgccgggcttcgggacg

SEQ ID NO: 60921 - DNA, 875 bp, Homo sapiens
  misc_feature: GYAE6OF01AE8MG.12.53.E09.1.454.CMB.1.raw
tcagatacgacgtacacgaccggtgctcgatttagagagagtgtgttgggtttgggggctttgcctgggctctgctgctcctcactctcctcactcaggacacgagggtcctgggcccagtctgccctgactcagcctcgcctccgtgtcgtcgggtctccgtggacagtcgactcaccactctcctgcgacgtcgggaccagctaggtgtagtcggttacggtaactttaacgtaccgttgtcctccgtacggtaaccaaacctaaccaacccgacggaaccaaacccgaccccctaaactccgtagttacgttaagttacgacggaacgggaccaacggtaccggcccggtacccggttacggttacgggtttacctttacggtccgttccgtttccgttcggtccggtaccgttccggacggttccgtacgacccgaaacccgtcccggccccgttacctacggtaacctacgttccgtcggaccggtccgtaccggacggtccggaacgggacggggtaacgggacggttaaccgttaagtttacgtttacggttcggttacgtccttaggaaagttcgggtacgggttacgggtaacttcggtaccgtttaacggtttaccgtaacggttcccgtttacggttaccggggtaccgggtaacggtaccgggaacgtcccggttaccgtaccgggtcccggttaacgggtccggtaacccggcccggtaaccggcccggggtcccctacccccggttccccggtacgtaaccctttcccggtcccgttaccccggtacccccttccccggtccggtttacccgttaccgtccgtttaacgggtaccgcggggtaaacccgggccggttacgg

SEQ ID NO: 60922 - DNA, 817 bp, Homo sapiens
  misc_feature: GYAE6OF01C64OM.12.53.E09.1.454.CMB.1.raw
  modified_base (183)..(183): a, c, t, g, unknown or other
  misc_feature (183)..(183): n is a, c, g, or t
  modified_base (274)..(274): a, c, t, g, unknown or other
  misc_feature (274)..(274): n is a, c, g, or t
  modified_base (371)..(371): a, c, t, g, unknown or other
  misc_feature (371)..(371): n is a, c, g, or t
tcagatacgacgtacacgaccggtgctcgatttagagagagtgtgttgggtttgggggctttgcctgggctctgctgctcctcactctcctcactcaggacacaggtccgtgggcccagtctgccctgactcagcctgccctcgtgtcgtgggtcctcgtgacagtcatccactactctcctncacgcggaccagacagtgagtgttacggacttactaaccgttgtcctaccttcgaaaccaacaaccaccaaggaccaaacaccccctaaanacatagtaagttagaggaaggccaagtaaccgcggtccgtcggtacggtttactacgtccgttcttcgtcgtaggtccacgtgtacgtcgacgaacnccggtccctcgtaacacgtacttcgcgtcgggacctcggacggtcgaaggacggacgaagggttacgttaagttttaaacgtcgttacgttacgttaccgattaagtacgggtgggttaaccggttaaggtaccttaacgggttactttaaccggtaagttaccggtttaaccgttaggggttacccgggaacggggtaaacgggtaaccttaacgggtaacccggtccgggttaaccccggttaaccggggtccggttaacccggaccgtaacccggggtaaccgtccccggtccccgggtaccccgtaaccccgggtttcctaccccggtttaacccgttttcccccggacccccgtttccccccgttacccggttaacccccgtttaacgggttaaaccgttccggggtaccttaacgggggcgggccccgggtttaacgggg

SEQ ID NO: 60923 - DNA, 621 bp, Homo sapiens
  misc_feature: GYAE6OF01AMY8V.12.53.E09.1.454.CMB.1.raw
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (454)..(454): a, c, t, g, unknown or other
  misc_feature (454)..(454): n is a, c, g, or t
  modified_base (521)..(521): a, c, t, g, unknown or other
  misc_feature (521)..(521): n is a, c, g, or t
  modified_base (614)..(614): a, c, t, g, unknown or other
  misc_feature (614)..(614): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctctcggtacaacaacaccaggacaaacgccccaaatcatgtattatgaggcactagcggccctgagggtttctatcgtcttctcgtggacctccgagtcgtgccaaaccgccggtcctccctgactaatccgtcgtgggccctacgnggtccnggaacggacgagggccggtattattactgggttctacactagttagtcgggacgggttaggtacgtacgttactttacggntttacggtccttaaggttcgggaccggtacggacctagtccgtacggacccgttacgtcgggtaccncgaccggaccgtccgttccgacccccgtgtcccgtacgttccctccccgtaacccctcccgttacctcccgtaacgttcgtactgcgtccggnggtaccg

SEQ ID NO: 60924 - DNA, 722 bp, Homo sapiens
  misc_feature: GYAE6OF01DYTZY.12.53.E09.1.454.CMB.1.raw
  modified_base (562)..(562): a, c, t, g, unknown or other
  misc_feature (562)..(562): n is a, c, g, or t
tcagatacgacgtacacgaccggtgctcgatttagagagagtgtgttgggtttgggggctttgcctggctctgctgctcctcactctcctcactcaggacacagggtcctgggcccagtctgccctgactcagcctgcctcgtgtctgggtctccgtggacagtcgatcaccatcctcctgcacgtggaccagcagtgagtggttaggtacttaataaccttgtcctccgtacggtaaccaaaccaaaccacccgaaggacctaaaaccgacccccaaaactcgaattaggtaattttacgaggaacgggtacctaacgtaacggcccggtccttacggtacggggttttctagtccgtcttccgtcgtcggtccgtccgtagtcgtacggacccaaccgtccggacccttcccgtagaacctaacgttcgtcggtacgggtcctacgacgggtcgtacggacggggacggtagggtacgttatttaacttacgtgttacgactactaagtgtacgggtacggtagtaacgcttacgtttgattccgtacgtgttaccgggngggtaacgacaggtccgttacggcccggttagtcggacacccggtaccgaggtcccgtaaccccgtcccggtcgtacgtcccgttaccgttccccggttaccccgtcccttaccgggttccttaacggtcgttaccgaggttccgggcgggtcggtccgg

SEQ ID NO: 60925 - DNA, 661 bp, Homo sapiens
  misc_feature: GYAE6OF01CRBJ2.12.53.E09.1.454.CMB.1.raw
  modified_base (191)..(191): a, c, t, g, unknown or other
  misc_feature (191)..(191): n is a, c, g, or t
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
  modified_base (446)..(446): a, c, t, g, unknown or other
  misc_feature (446)..(446): n is a, c, g, or t
  modified_base (500)..(500): a, c, t, g, unknown or other
  misc_feature (500)..(500): n is a, c, g, or t
  modified_base (639)..(639): a, c, t, g, unknown or other
  misc_feature (639)..(639): n is a, c, g, or t
tcagatacgacgtacacgaccggtgctcgatttagagagagtgtgttgggtttggggctttgcctgggctctgctgctcctcactctcctcactcaggacacgagggtcctgggcccagtctgccctgactcagcctgccttcgtgtctgggtctcctggacagtcgatcacatctctgcacgtgggaccngcagtgagtggttggacttaattaaccgttgtcctacgtagaaccaaacaaccaccgaaggacaaacgaccccaaatcataggtatttagnggacggacaacgtaacgccggtcccttaggtaggtttctaagtcgtctttcncgtcggtcctaccggtatcgtacgacaacgccgtccttccagacaacgtctcgcgggtcaccgagtgaggacggagacggtagttattagttagtgttacgatactatacgngggtagggtattaaggcttaccgtttagagttacctacgtttacggtaccgggnggtaaacggaaccgacgttaacggccgtaaccgttcgtcggaacgtacccggaccacggtcctaacccggccccgttcggtacctaaccgttccgttaccccgtacccttaccccctccggttacttacgtccgttacnccggtaagcccggtgggtaccc

SEQ ID NO: 60926 - DNA, 791 bp, Homo sapiens
  misc_feature: GYAE6OF01DEZFU.12.53.E09.1.454.CMB.1.raw
tcagatacgacgtacacgaccggtgctcgatttagagagagtgtgttgggtttgggggctttgcctggctctgctgctcctcactctcctcactcaggacacagggtccgtgggcccagtctcgccctgactcacgcctcgccctccgttgtcgttcgggtcctccgtggactagtcgactcaaccacttcctcctgctacgtcgggaccacgcagtgagttggttgggtaacttacttaaccgttcgttccgtccgtacggtaaccaaccaaccacccgaggaaccaaaccgaccccaactacattacgtaatttagtggacgtacaacgtacgtcccggtccgtagttacgggtttacttacgtaccgtctttccgtcgtcgtacccgtcggtacgttcgtacgaccaaccgcccggtcccttccgtacgtaacctcttaccgtcgggtcgtcccgtacggacggtcgaggaaccgggcggaggtcggttaatttcgttagtttgttacgtcgtactatacgtaggtacggaggttacggtcgtaccttcgttacgaccttacggttacgtccgggtaacggggaacgaccgtaacggttccgtcccggtaacccggtttacgacccgtacggacccgtaccgtaaccggttccggtaacccccgttccccggtacggttacccttaaccggttccccgtttccccggtttcccccgtaccccgtttcccgttaacggtttacccgttacggttacctacgggtttacggcggggtaccggtaccgggg

SEQ ID NO: 60927 - DNA, 807 bp, Homo sapiens
  misc_feature: GYAE6OF01CC13X.12.53.E09.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctcgcctccgtgtctgggtctcctggacagtcgatcaccatctcctgcacgtaggaaccngcagtgacggttggtagttataactntcgtcctccgtacggtaaccaacgacgccaacccgaggctacggaccgacccccaaactctagttagttagtttttagagttcgtacaacttaaccgtcccggtacccgttaggttacggggttttcgacgtacttccgtcctttccgtcgtcgcctacgtacgttctacgaccgtaccgcccggtcctaccgtacgtaccgtactccgtacggtccgggtacctaccggacgtccggtagggaacggaccggtaacggttcgttaaggttaacttttaacgtttacgtttcggacctaacggtacctaacgtaactaaccgttaacgaacgtaccgtaacggacccttaccggaacccttttaccgtttccggttttacgttacccgggttaaacgggtaacgggtaccgggaaaccgttaccgggttacccttcccgggtaacctaccggtacccaaccggtaacccgacccggtaaaccccctacccgtacgttacggtacccttacccgttcccgtttaaccccccgttaccccgttaccccgttcccttaaaccgttcccggttaccgttcgtaacccggg

SEQ ID NO: 60928 - DNA, 758 bp, Homo sapiens
  misc_feature: GYAE6OF01A37MF.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactcgggaccagcagtgatgttgggacttataacttgtctcctgtaccaacaaccaccaggacaaacgaccccaactcatagtatttagtggaggacgaactaacgccggccctcggtacgggtttcttactccgtcttctctcggtctccggtagtctggaccaaccgaccggccctcccgtacgacctaactccgtcgtcgggccctaccgacggtcgtaggaacgggacggacgggtacggtaagtttaacttcgtcggtttacgccttagtaacgttagtcgggtacggggttaacgtacgtaccgttaaccgtttcggtaacgttcgttaccgtttaacggtttccggggacgggttaaccggggacccgtaaacgggtcccgtaccgggtaccccgtccggttacgggtaccctacggtacccgtaacggacccgttccccgtcccccggtaccggtacctaccccgtttccggttccccggttacccccccggtcccctttaccccgtacccggtttacccggtttaccggtacgtttacccggacggttccgggtacccgggtccggg

SEQ ID NO: 60929 - DNA, 761 bp, Homo sapiens
  misc_feature: GYAE6OF01CPKZ9.12.53.E09.1.454.CMB.1.raw
  modified_base (174)..(174): a, c, t, g, unknown or other
  misc_feature (174)..(174): n is a, c, g, or t
  modified_base (432)..(432): a, c, t, g, unknown or other
  misc_feature (432)..(432): n is a, c, g, or t
  modified_base (757)..(757): a, c, t, g, unknown or other
  misc_feature (757)..(757): n is a, c, g, or t
tcagatacgacgtacacgaccggtgctcgatttagagagagtgtgttgggtttgggggctttgcctggctctgctgctcctcactctcctcactcaggacacagggtcctgggcccagtctgccctgactcagcctgcctccgtgtcgtggtcctccgtgactgtcatccactntcctctgctacgtcggaccagcagtgtagtcggttaggtacttaacttaccgttgtaccgtccgtacggaaaccaaaccaaccacccgtaacggaaccaaacccgtaaccccctaatcgtactacgtagttttaggacggacggtactaaccgttacggcccgtccgttaggttacgggtttacttcgtccgttcgttaccgtcggtacgtccgttaccggtacgtcgtacggaccaaccgttcccgtcctccgtaanaaccttacgttccgtacggtcggtacctaccggacggtagtacgggaggacggtacgtaagtttactttaacgttcgttagtacgtccttagtaacgttagggtaccgggtacgggttaacttacgtacccgtttacgtttacggtacctttacgggtacccttaacgggttcgggaacggttacggaaaccgacgtccggtaccggtacccggttacgtcgggacctaccgggtaccgacgttaccgtccccgtaccgtcggtcccttacgttcccgtccccgttacccctacccgttcctagtccttagcggtagcgttcggngacg

SEQ ID NO: 60930 - DNA, 888 bp, Homo sapiens
  misc_feature: GYAE6OF01B5KXY.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctctggacagtcgatcaccatctcctgcacgtgggaccagcagtgtattgttgggactttataaccttgtccttccgtagtaacccaaacgaaccaaccaggaccaacgacccccaatcatgtattagtaggaggcacgtacgaccggtcctcggttagggtttctactcgtcttctcgtcgtcgtccgtgtctgacaaccgtccggaccctcctcgtaacctacttccgtacgtcgggctccgtacggcgtacggaacggacgggtacgggtcgttactttaacgtttacgttcgttggtaccttacgtagttacggtcgggtacgggttaacgtaacgttaccgttaactttacggtacgtttccggtaccccgttttacgggtacccggggtaaccggggtaaacggtaaccgttaaccgggtccccgttaccggggtttaaacccccgggtttcccggggtttaacccgggacccgggtaacccggttaaccccccggggtaaaccgggttacccccggttccccccggggtttaccccccccgggttaccggggtttaaccccccggttttaaccggtttccccccgggttttaccccccggtttccccccggttaaccccccgttttcccggtttaaaaccccccggtttaccccgttttacccggtttaaacccgttaccccggggggttaacgtacccggggggtttccccgggtaaaccccggggg

SEQ ID NO: 60931 - DNA, 792 bp, Homo sapiens
  misc_feature: GYAE6OF01ARIGN.12.53.E09.1.454.CMB.1.raw
  modified_base (188)..(188): a, c, t, g, unknown or other
  misc_feature (188)..(188): n is a, c, g, or t
  modified_base (779)..(779): a, c, t, g, unknown or other
  misc_feature (779)..(779): n is a, c, g, or t
tcagatacgacgtacacgaccggtgctcgatttagagagagtgtgttgggtttgggggctttgcctgggctctgctgctcctcactctcctcactcaggacacagggtcctcgggcccagtctcgccctgactcagcctgcctccgtgtcgtgggtcctccgtggacagtcgatcaccatctcctgcncgtcggaccagcagtgagtggttacggtaactttactaccttgtcctccgtacgtaaccaaacaaccgacccgtaaggacctaaacccgaccccctaaatccgtaatgttaagtttaacgcggaacgggacctaaccggtaaccggtccggtacccgttaacgggttacggggttttaccttaccgtcgttccttccgttcgtccggtaccgtaccgtaggtccgtacggacgtaaacccgccggtccctaccggtagtaacctaacgtcgtacggccggtactccgtagggtacctaggggaacggaccgggtacggttaacgttactttaacgtccgtttagttacgtctaacggttacgtacgggtcggttacggtaggtaaccgttacgttacgtttcgtacgttccggttaacgttcccgggtacgggtaaccgggaccgtaaacggtacggtaccgttccgggaacccggttggtaaccgggtacccaacgggtcccggacgtacccgtcccgtccggtaccgtcccgtaccttcccggtacctccccgtcccttacggtcctacgtaccgtacccgtagtcggnggtacccgtcggg

SEQ ID NO: 60932 - DNA, 833 bp, Homo sapiens
  misc_feature: GYAE6OF01ETNFP.12.53.E09.1.454.CMB.1.raw
  modified_base (134)..(134): a, c, t, g, unknown or other
  misc_feature (134)..(134): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcancctgcctccgtgtcgtggtctccgtggacagtcgatcaccatcctcctgcactgggaccagcagtagatggttagggtacctttaattaaccttgtcctccgtaggtaaccaaccaaccacccaggacaaaaccgccccaaactcagtagtactttacgtaggacggacaacgtaacggccggtacccgttacgttaggggtttttaccttacgttccgtcctttaccgtcgttacggtacccttaccgtaacggttcctacgtaacctaccgtacccggtccccgttaccccgtacggtaaccctaaccgttcgttacccgttcggggacccttacccggtagggtcccgtaagggacgggtaacggtacgggtaccttagtaacgttttaacgtttagttcgacttaccggtacttacgtaacgttaactaaaccgtaaaggcctaacggtaacccgaccgttaccccgttacccttttacgtttaccggttaccgtttaacggggtaaccggtaacgggtaacccgtaacgggtacccctaaccgggttcccgtaacgtcccgtaacccgaacccgtaacccggtacccctaacccccgtagttacccgttaccctaccgttcccgttacccgttcccccgttacccctcccgttacccgtacggtacctttaacgtcgtacggtcgggtaccggg

SEQ ID NO: 60933 - DNA, 618 bp, Homo sapiens
  misc_feature: GYAE6OF01EZUYA.12.53.E09.1.454.CMB.1.raw
  modified_base (216)..(216): a, c, t, g, unknown or other
  misc_feature (216)..(216): n is a, c, g, or t
  modified_base (261)..(261): a, c, t, g, unknown or other
  misc_feature (261)..(261): n is a, c, g, or t
  modified_base (326)..(326): a, c, t, g, unknown or other
  misc_feature (326)..(326): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcacatctctgcactgggaccagcagtgatgttggacttataaccttntctctgtaccaacaacaccagcaaacgccccaaactcatgattangaggcactaagcggcctcgtacgggtttctatcgcttctcgtcggtcctcgagtcgtcggcaacnccggcctcctagactaatcgtcgcggtcctccgaggtctaggagggaacggtaggtacggtatttaacttaacgtggttgtcctactatacggtggtacgggttagtacgtactacgtttccgagttcgttacctagtccgggtacgggtaacggaccgacgtcgtacgtacccggtcgtacgggacacgaccggaacgtcccgtccgtcccccgtcgtaccgtaccgttccgtccgtaccccgtcccttacccgtccgtaccgttcgttactagtcggtcgtccgggtacg

SEQ ID NO: 60934 - DNA, 829 bp, Homo sapiens
  misc_feature: GYAE6OF01BJ8T1.12.53.E09.1.454.CMB.1.raw
  modified_base (278)..(278): a, c, t, g, unknown or other
  misc_feature (278)..(278): n is a, c, g, or t
tcagatacgacgtacacgaccggtgctcgatttagagagagtgtgttgggtttgggggcgtttgcctgggctctgctgctcctcactctcctcactcaggacacagggtcctgggcccagtctgccctgactcagcctgcctcgtgtctggtctcctggacagtcgatcaccgtctcctgcacgtcggaccagtatgtatttagaatttgacctagtctccgtagtaaccaactaactccccggacaaacgtccccgtaaagttaatctagtttacgnggagggcctaacgtaacgccggtacccgtacgtaaggttacgtttctgtactccgtcgtttccgtcgttcggtaccttaccgaaggtccgtcgggtacccggtaccccgggtacccttccccgtaagaaccctaaagttaccgtccggttacggggacccttaccggtacgggtacccgttaacggggaacgggtacggaccgttaccgtaactttaaacgtttacccgttaacgttcggcctttcggtaccttactaaggttaacggttacggggttaacgttacgtacgtacgtttacggggtttcggggttaggttacccgggaggggtaacccgggtaaacgttaaccgggtaccgtaacccggtttaccgtaaagtacccgaacgggtacccgtaacgggtccccttaacccggtcccccgttacgtacctacccgtttccctacccgttaccccctccccggttacccgttaaccgttcccggttaggttaccctcgggtacgacgggtcgggtcccgacggtaacggacggtcggtcctaaggg

SEQ ID NO: 60935 - DNA, 840 bp, Homo sapiens
  misc_feature: GYAE6OF01EO7DY.12.53.E09.1.454.CMB.1.raw
  modified_base (140)..(140): a, c, t, g, unknown or other
  misc_feature (140)..(140): n is a, c, g, or t
  modified_base (826)..(826): a, c, t, g, unknown or other
  misc_feature (826)..(826): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcacgcctcncctccgtgtccgtgggtctcctggacagtcgactacacctatcctacctcgcgacgtcgggaccaagctagtggacgtggttaggtaactttactaaccttgccttaccgtcggtaaacccaacaaaccgcccaaggaccaaaaccgaccccctaaatcgaactaggttactttagacggaacggacgtaacgaacggccggtacccgtacggttacgggtttacctacgttccgtcgtttccgtaccgtcgggtccgttacccgtacggtttacgacccgggtaaccaaccgggtacccgtcccttacccggtacggtaaaccttacttcccgaacggttcccggtacctacccggtaggaccggttacggaacgggtacgggacgggttaccgtttaattaaaccgttacggttcgtttccggaaacttacgttaaggtggttaaccgggttacgggtacggtactacgggttacctttaacgcgttttcgcccgttacggtaccgggggtaacgaaccgggtaaccgcggttaccggtaacccggtccggtaccgggttcgggaaccccagggttacccccacgggtccctaccccggggcccggttaaccctcggttacccccgtcgtttacccccgtcccggtacccttccgtaccccgtcttacgggtctacgaccgggnggtaccccgggtag

SEQ ID NO: 60936 - DNA, 1013 bp, Homo sapiens
  misc_feature: GYAE6OF01AURI3.12.53.E09.1.454.CMB.1.raw
tcagatacgacgtacacgaccggtgctcgatttagagagagtgtgttgggtttggggctttgcctgggctctgctgctcctcactctcctcactcaggacacgagggtccgtcgggccctgtcctcgccctgacctcacgcctcgcctcgtgtcgtggtctccgtggacacgtcgactccacctcttcctccgtacgaccgaaccggtcgggaaccagtctaggtgtacggttagggttagtaactttaaccttaccgttccgttccttaccgtacgtaaaccccaacctaacccgaacccggaaggaacccaaaaccccgtacccctaaactaccggtattagttaacgtttagtaaccggtacggaacctaacggtaaacccgggccccggttacccgtttaacggggttaacggttttcccgtaacgttccggttcccgtttacccggtaccggtccggtaaaccccggttttccggaccggttacgggtacccggtaaacccggtaccgaaccccccggttacccgttaccccgttaacgggtaaaaccccttcggtttacccccggtacgggtttacccgggtaacccgttaccggttacggggtacggttacccggggtaaacgggtaaaacccggggtacggggttttaacccgtttaaaaggttttacccgttttaacggttcgggttaacccggttcgtttaaccgttaacgggttaacgggttaacgggttaccggggttaaccgtttaccggttaaaccggtttcgtttaaccgggttaccgtttcccgttacggtttaccgggtaacccgggtcgggtaaccggacggttaaccgtaccgggtacccgggttaccggtaccgggttaccggtacccggtacccggtaacggtacccggtaccccggttcccggacccgttccgttacccgtccgttaacccgttcccgttccggtacccttcccggtacgttaccgtctacgtcgtcgggtcgcggtacgg

SEQ ID NO: 60937 - DNA, 526 bp, Homo sapiens
  misc_feature: GYAE6OF01E1P5K.12.53.E09.1.454.CMB.1.raw
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
tcagatacgacgtacacgaccggtgctcgatttagagagagtgtgttgggacttataaccttgtctcctggtaccaacaacacccaggcaaagccccaaactcatgatttatgagggcactaagcggccctcaggggtttctatcgcttctctggctccgagtctggcaacacggctccctgacaatctctgggctccaggctgaggacgaggccggattatactgttgctcatatgcgggtatacgcactttccgattcgtcctattcggcggaggaccaagctgaccgtctggggtcacggccaaggctcgcccctgggtccacttccgtcgtttccccaccgttcctactacgtcgtatcgtgacgcggactcgggactaacgggccacgacgttaacgctggacacgtgcncgttacaggnttacncgcncacgcnacacgnacgcgacacgtgcgagacactacncacgacanctacgacntacncgacngcncgactgacgcacacncncacancnngcg

SEQ ID NO: 60938 - DNA, 174 bp, Homo sapiens; identical to SEQ ID NO: 60837
  misc_feature: GYAE6OF02JDAKE.12.53.E09.1.454.CMB.1.raw
  modified_base (173)..(174): a, c, t, g, unknown or other
  misc_feature (173)..(174): n is a, c, g, or t

SEQ ID NO: 60939 - DNA, 378 bp, Homo sapiens
  misc_feature: GYAE6OF02GH80O.12.53.E09.1.454.CMB.1.raw
  modified_base (375)..(378): a, c, t, g, unknown or other
  misc_feature (375)..(378): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggaggaccaagctgaccgtctgggtcagcccaaggctgccccctggtcactctgttcccaccctcctctacgtcgtatctgagcggctggcaaggcgcatagnnnn

SEQ ID NO: 60940 - DNA, 174 bp, Homo sapiens; identical to SEQ ID NO: 60837
  misc_feature: GYAE6OF02H53IY.12.53.E09.1.454.CMB.1.raw
  modified_base (173)..(174): a, c, t, g, unknown or other
  misc_feature (173)..(174): n is a, c, g, or t

SEQ ID NO: 60941 - DNA, 589 bp, Homo sapiens
  misc_feature: GYAE6OF02FFNQG.12.53.E09.1.454.CMB.1.raw
  modified_base (268)..(268): a, c, t, g, unknown or other
  misc_feature (268)..(268): n is a, c, g, or t
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggccaaagcccccaaatcatgatttangagggcactaagcggccctcagggtttctatcgcttctctgctcgagtctggcaacacggcctcctgacaatctcgtggctccaggctgaggacgaggcggatttatactgttgctcatagtggcgggtagtagtctacttcgtattcgtccttagttcggacgggacggaccaagcgtacgaccgtccgtgggtaccacgcccgaaacggtccgtccgccccccgttcggtcctacccgttccttccggttaccccctaaccccttcccgttaccgttaccggttccgttaaccgttcgtacggtacggccgggtaccgg

SEQ ID NO: 60942 - DNA, 520 bp, Homo sapiens
  misc_feature: GYAE6OF02GU4M4.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcagggtttctatcgcttctctggctccgagtctggcaacacggcctccctgacaatctctgggctccaggctgaggacgaggcggattattactgttgctcatatgcgggtagtagcactttcgatgtcctattcggcggaggaccaagctgaccgtcgtgggtcagcccaaggctcgcccctcggtcacgtctcgttcccgccctcctctacgtcgtactctgagcggtcg

SEQ ID NO: 60943 - DNA, 521 bp, Homo sapiens
  misc_feature: GYAE6OF02GRRA7.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgattgtcctagttcggcgagggaccaagctgaccgtctgggtcagcccaaggctcgcccctggtcacgtctcgttcccgcctcctctacgtcgtactcgtgagcggtcg

SEQ ID NO: 60944 - DNA, 175 bp, Homo sapiens
  misc_feature: GYAE6OF02JVXG8.12.53.E09.1.454.CMB.1.raw
  modified_base (170)..(175): a, c, t, g, unknown or other
  misc_feature (170)..(175): n is a, c, g, or t
tcagatacgacgtacacgaccggtgctcgatttagagagagtgtgttggtttggggaagaggaagactgacggtccccaggagttcaggtgctgggcacagcggccctgggctgcctggtcaaggactacttcctacgtcgtatctgagcgggctggcaaggcgcatagnnnnnn

SEQ ID NO: 60945 - DNA, 515 bp, Homo sapiens
  misc_feature: GYAE6OF02GOMWB.12.53.E09.1.454.CMB.1.raw
tcagatacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgagggcactaagcggccctcaggggtttcttatcgcttctctggctccgagtctggcaacacggcctccctgacaatctctgggctccaggctgagacgaggcggattattactgttgctcatatgcgggtagtagctactttcgattgtcctattcggcggaggaccaagctgaccgtctgggtcagccaagctgcccctggtcactctcgttcccacccttcctctacgtcgtactctgagcggcg

SEQ ID NO: 60946 - DNA, 379 bp, Homo sapiens
  misc_feature: GYAE6OF02IQFQF.12.53.E09.1.454.CMB.1.raw
  modified_base (375)..(379): a, c, t, g, unknown or other
  misc_feature (375)..(379): n is a, c, g, or t
tcagatacgacgtacacgaccggtgctcgatttagagagagtgtgttgggacttataaccttgtctcctggtaccaacaacacccaggcaaagccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggaggaccaagctgaccgtcctgggtcagcccaaggctgccccctggtcactctgttcccaccctcctctacgtcgtatctgagcggctggcaaggcgcatagnnnnn

SEQ ID NO: 60947 - DNA, 519 bp, Homo sapiens
  misc_feature: GYAE6OF02IXF8U.12.53.E09.1.454.CMB.1.raw
  modified_base (491)..(491): a, c, t, g, unknown or other
  misc_feature (491)..(491): n is a, c, g, or t
  modified_base (516)..(516): a, c, t, g, unknown or other
  misc_feature (516)..(516): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctcctgacaatctctgggctccaggctgaggacgaggcggattattactgttgctcatatgcgggtagtagcactttcgattgtccttagttcggcggaggaccaagctgaccgtctgggtcagcccaaggctcgcccctcgtcactctcgttcccnccctcctctacgtcgtatctgacgnggc

SEQ ID NO: 60948 - DNA, 513 bp, Homo sapiens
  misc_feature: GYAE6OF02IHYKF.12.53.E09.1.454.CMB.1.raw
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgattatgaggcactaagcgccctnagggtttctatcgcttctctggctccgagtctggcaacncgcctcctgacaatctctggctcagctgagacgaggcgattatactgttgctcatatggcgggtagtagctacttcgattgtcctagttcggcggaggaccaagctagaccgtcgtggtcacgccaacggctcgcccctgtcacgtctcgttcccgccctcctcgtacgtcgtatcgtgacgcggtcg

SEQ ID NO: 60949 - DNA, 532 bp, Homo sapiens
  misc_feature: GYAE6OF02I8ZH9.12.53.E09.1.454.CMB.1.raw
  modified_base (330)..(330): a, c, t, g, unknown or other
  misc_feature (330)..(330): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacncggcctccctgacaatctctgggctccaggctgaggacgaggcggattattactgttgctcatatgcgggtagtagcactttgattgtcctagttcggcggagggaccaagctgaccgtctgggtcacgcccgaaaggctacgccccctcggtcaccgtctccgttcccacccttcctctacgtcgtatctggacgcggtcg

SEQ ID NO: 60950 - DNA, 527 bp, Homo sapiens
  misc_feature: GYAE6OF02IAIVY.12.53.E09.1.454.CMB.1.raw
  modified_base (363)..(363): a, c, t, g, unknown or other
  misc_feature (363)..(363): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtacaacaacacccaggcaaacgccccaaaactcatgatttatgagggcactaaagcggccctcaggggtttctatcgcttctctggctccgagtctggcaacacggcctcctgacaatctctgggctccaggctgnggacgaggcggattattactgttgctcatatggcggtagtagctactttcgattgtcctagttcggcggtaggaccaagctgaccgtctgggtcngccaaggctcgccccncggtcacgtctcgttcccgcccttccncttacgcgtactcgtcgaggcggtcg

SEQ ID NO: 60951 - DNA, 522 bp, Homo sapiens
  misc_feature: GYAE6OF02JK4HN.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgatttatgagggcactaagcggccctcaggggtttcttatcgcttctctggctccgagtctggcaacacggcctccctgacaatctctgggctccagctgaggacgaggcggattagtactgttgctcatatgcgggtatagcactttcgattgtctagttcggcggagggaccaagctgaccgtctgggtcagcccaaggctgcccctggtcaccttctcgttcccaccctcctctacgtcgtactctcgaggcggtacg

SEQ ID NO: 60952 - DNA, 533 bp, Homo sapiens
  misc_feature: GYAE6OF02GA2JU.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgaggcactaagcggcctcaggggtttcttatcgcttctctggctccgagtctggcaacacggcctcctgacaatctctggctcagctgagacgaggcggattatactgttgctcatagtgcgggtagtagcactttcgattcgtccttagttccgggcggtagggaccaagcgtcgaccgtccgtggtcacgcccgaaggctcgcccccgtcggtccacgtctcgttccccgcccttccctctacgtctactcgtcgacgcggcg

SEQ ID NO: 60953 - DNA, 174 bp, Homo sapiens; identical to SEQ ID NO: 60837
  misc_feature: GYAE6OF02H94GP.12.53.E09.1.454.CMB.1.raw
  modified_base (173)..(174): a, c, t, g, unknown or other
  misc_feature (173)..(174): n is a, c, g, or t

SEQ ID NO: 60954 - DNA, 584 bp, Homo sapiens
  misc_feature: GYAE6OF02JR8XS.12.53.E09.1.454.CMB.1.raw
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacacacccaggcaaagcccccaaactcactgatttatgaggcactaagcggccctgaggggtttctatcgcttctctggctccgagtctggcaacncggctccngacatctctggctcgaggctggagacgnggacggatttatacgttgtgtctacatagtggacgggttatacgtctacttttcgattcgttacctagttcgggcggaagggacctaagctacggacccgtcgtgggtccaagcccgaaaggtcgtccggcccccttcggtctacccgtcgttccgttccccgtcccttcccgtaccgttaccggttccgttaacttccgtacggtacggcccgggtcgg

SEQ ID NO: 60955 - DNA, 208 bp, Homo sapiens
  misc_feature: GYAE6OF02GPZAF.12.53.E09.1.454.CMB.1.raw
  modified_base (178)..(178): a, c, t, g, unknown or other
  misc_feature (178)..(178): n is a, c, g, or t
  modified_base (181)..(208): a, c, t, g, unknown or other
  misc_feature (181)..(208): n is a, c, g, or t
tcagatacgacgtacacgaccggtgctcgatttagagagagtgtgttgggtttgggggaagaggaagactgacggtcccccaggagttcaggtgctgggcacaggccggccctgggctgccctgggtcaaggactacttcctacgtcgtatctgagcgggctggcaaggcgcataagnacnnnnnnnnnnnnnnnnnnnnnnnnnnnn

SEQ ID NO: 60956 - DNA, 530 bp, Homo sapiens
  misc_feature: GYAE6OF02G9NUJ.12.53.E09.1.454.CMB.1.raw
  modified_base (402)..(402): a, c, t, g, unknown or other
  misc_feature (402)..(402): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctcaggggtttcttatcgcttctctggctccaaggctggcgaccgggcctccctgacaatatctgggctccaggctgaggacgaggctcattactactgctgctcatatggagttanagcacgttgggtgttcggcggcgggacaaaggtgaccgtccgtaagtcagcccaaggctacgcccctcggtccactcctcgttccctaccctcctcctaccgtcgtatctgacgcgggctggcaacgg

SEQ ID NO: 60957 - DNA, 528 bp, Homo sapiens
  misc_feature: GYAE6OF02I72D2.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttctatcgcttctctggctccgagtctggcaacacggcctccctgacaatctctgggctccaggctgaggacgaggcggattattactgttgctcatatgcggtagtagcactttcgattgtcctattccggcggacgggacaagctacgaccgtccgtgggtcacgcccaaggctcgccccttcggcacgtctcgttcccaccctcctcgtacgtcgtactctgagcggtcg

SEQ ID NO: 60958 - DNA, 534 bp, Homo sapiens
  misc_feature: GYAE6OF02IK7S7.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaaagtccccaagttaatcatttatgaggcactaaagcggccctcaggagtttctgatcgcttctctggctccaagctggcgaccgggcctccctgacaatctctgggctcaggctgaggacgaggcgtattattactgttgctcatatgcgggtagtagctacttcgatgtcctattcggcggagggacaagctgaccgtctgggtcagcccaaggctcgcccccgtgtccgactctcgttccctacccctctcctacgtctatctgacggtcggcgtgcgaaggccg

SEQ ID NO: 60959 - DNA, 528 bp, Homo sapiens
  misc_feature: GYAE6OF02JRMWK.12.53.E09.1.454.CMB.1.raw
  modified_base (380)..(380): a, c, t, g, unknown or other
  misc_feature (380)..(380): n is a, c, g, or t
  modified_base (523)..(523): a, c, t, g, unknown or other
  misc_feature (523)..(523): n is a, c, g, or t
tcagatacgacgtacacgaccggtgctcgatttagagagagtgtgttgggtttggggcgtttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctcaggggtttctagtcgctttctctggcctccgagtctggcaacgcggcctcctgacatctctggctcaggctgagacgaggcgattacttacngttgctcatagtgcggtagtagctactttcgattcgtcttagttcggcggtacggacaagctagaccgtcgtggtcagccgaagctcgcccctggtaactcgtcgttcccacctcctctacgttcgtactcgtcgacggcggntacgg

SEQ ID NO: 60960 - DNA, 177 bp, Homo sapiens
  misc_feature: GYAE6OF02FYL29.12.53.E09.1.454.CMB.1.raw
  modified_base (173)..(177): a, c, t, g, unknown or other
  misc_feature (173)..(177): n is a, c, g, or t
tcagatacgacgtacacgaccggtgctcgatttagagagagtgtgttgggtttgggggaagaggaagactgacggtcccccaggagttcaggtgctgggcacagcggccctgggctgcctggtcaaggactacttcctacgtcgtatctgagcgggctggcaaggcgcatagnnnnn

SEQ ID NO: 60961 - DNA, 615 bp, Homo sapiens
  misc_feature: GYAE6OF02I3S8A.12.53.E09.1.454.CMB.1.raw
  modified_base (326)..(326): a, c, t, g, unknown or other
  misc_feature (326)..(326): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgagggcactaagcggccctcaggggtttcttatcgcttctctggctcgatctgcaacncggcctccctgacatctctgggctcaggctgaggacgaggcgatttattactgttgctcatatggtcgggtagtagctactttcgattcgttccttagtttcgggaccggggtacgggaacccgaaggtccgttacggacccgttccgttcggggtctaccggacccgaacggtccgtccggccccccgttcggtcctacccgttcccgttaccggtttccccctaccccgttcccgttaccgttaccggttccgttaccgttccgtcggtaccggccgggttacccgg

SEQ ID NO: 60962 - DNA, 522 bp, Homo sapiens
  misc_feature: GYAE6OF02I35GU.12.53.E09.1.454.CMB.1.raw
  modified_base (289)..(289): a, c, t, g, unknown or other
  misc_feature (289)..(289): n is a, c, g, or t
  modified_base (510)..(510): a, c, t, g, unknown or other
  misc_feature (510)..(510): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctnaggggtttcttatcgcttctctggctccgagtctggcaacacggcctcctgacaatctctgggctccgaggctgacggacgaggcggattattactgtgctcatatgacgggtagtacgctactttcgattgtccttagttcggcggaggaccagctgaccgtcgtggtcacgccagctcgcccctgctactctcgttcccacctcctctacgtcgttacncgtgagcggtcg

SEQ ID NO: 60963 - DNA, 382 bp, Homo sapiens
  misc_feature: GYAE6OF02GY6JE.12.53.E09.1.454.CMB.1.raw
  modified_base (375)..(382): a, c, t, g, unknown or other
  misc_feature (375)..(382): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggctgattattattgcagctcatatacaagcagcagcaccctctttgtcttcggaatgggaccaaggtcaccgtcctacgtcagcccaaggccaaccccactgtcactctgttcccgccctcctctacgtcgtatctgagcgggctggcaaggcgcatagnnnnnnnn

SEQ ID NO: 60964 - DNA, 558 bp, Homo sapiens
  misc_feature: GYAE6OF02IZM1W.12.53.E09.1.454.CMB.1.raw
  modified_base (353)..(353): a, c, t, g, unknown or other
  misc_feature (353)..(353): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaatcatgattatgaggcactaagcgccctcgaggggtttcttatcgcttctctggctccgagtctggcaacacggcctcctgacatctctgggctcngctgaggacgaggcggattattactgtgctcatagtggcgggtagtagtctacgtttcgattcgtcctagttcgggacgggagggaccaagctacggaccgtccgtggtcacgccgaacggctccgccccgtcggtcaccgttcctccgttaccccacccttcccgttcttaccggtcgttacttccggtcgacggtcggtccgg

SEQ ID NO: 60965 - DNA, 524 bp, Homo sapiens
  misc_feature: GYAE6OF02F9LYY.12.53.E09.1.454.CMB.1.raw
  modified_base (331)..(331): a, c, t, g, unknown or other
  misc_feature (331)..(331): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcgaggggtttcttatcgcttctctggctccgagtctggcaacncggcctccctgacatctctgggctcaggctgaggacgaggcggattattactgttgctcatatggcgggtagtagctactttgattgtccttattcgggcggagggaccaagctaggaccgtccgtgggtcagcccaaggctcgcccctgtcactctcgttcccgccctcctctacgtctatctgcgcggtcg

SEQ ID NO: 60966 - DNA, 175 bp, Homo sapiens
  misc_feature: GYAE6OF02IDGQB.12.53.E09.1.454.CMB.1.raw
  modified_base (173)..(175): a, c, t, g, unknown or other
  misc_feature (173)..(175): n is a, c, g, or t
tcagatacgacgtacacgaccggtgctcgatttagagagagtgtgttgggtttgggggaagaggaagactgacggtcccccaggagttcaggtgctgggcacagcggccctgggctgcctggtcaaggactacttcctacgtcgtatctgagcgggctggcaaggcgcatagnnn

SEQ ID NO: 60967 - DNA, 559 bp, Homo sapiens
  misc_feature: GYAE6OF02H6KDB.12.53.E09.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (408)..(408): a, c, t, g, unknown or other
  misc_feature (408)..(408): n is a, c, g, or t
tcagatacgacgtacacgaccggtgctcgatttagagagagtgtgttgggtttgggggtcgtttgtcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcttgtaaccaacaacacccaggcaaaacgcccctaaaactcaactgattatgaggcataagcggccctgtagggtttctatcgctttcnctggctccgagtctgcaacacggcctcctgacaatcctctgggctccaggtcnggacggacaggcggtattacgtttactgttgctcaattcgnggcgggttatacgctacttttgacttgttaccttagttcgggacggagggaccaggcctgacccgtcgtggactagcccgaaggctcggcccctggtacacctcgtcttcccaccccttcttcgtacgtcgtactccgtgtacggcggtcg

SEQ ID NO: 60968 - DNA, 173 bp, Homo sapiens; identical to SEQ ID NO: 60830
  misc_feature: GYAE6OF02IYZL9.12.53.E09.1.454.CMB.1.raw
  modified_base (173)..(173): a, c, t, g, unknown or other
  misc_feature (173)..(173): n is a, c, g, or t

SEQ ID NO: 60969 - DNA, 528 bp, Homo sapiens
  misc_feature: GYAE6OF02F239G.12.53.E09.1.454.CMB.1.raw
  modified_base (442)..(442): a, c, t, g, unknown or other
  misc_feature (442)..(442): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctcctgacaatctctgggctccaggctgaggacgaggcggattattactgttgctcatatgcgggtagtagcactttcgattgtcctattcggcggagggaccaagcnggaccgtccgtgggtcacgcccaaggcctcgcccctcggtccacgtcctcgttcccacccttcctctcgtcgtatctgacgcggcg

SEQ ID NO: 60970 - DNA, 391 bp, Homo sapiens
  misc_feature: GYAE6OF02HAVLT.12.53.E09.1.454.CMB.1.raw
  modified_base (261)..(261): a, c, t, g, unknown or other
  misc_feature (261)..(261): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
  modified_base (381)..(391): a, c, t, g, unknown or other
  misc_feature (381)..(391): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttctgatcgcttctctggctccaagtctgactacacggcctccctgaccatctctgggctccaggctgaggacgaggctgattattattgcagctcatatacaagcagcacgccaccccttntttgtccgttacggaaggtcgggaaccaaggtccaccgtctacgtcacgccaaggcccaacccntgcactctcgtccccncctctctacgtcgtatcagacgcggctgacaggcncagtnnnnnnnnnnn

SEQ ID NO: 60971 - DNA, 516 bp, Homo sapiens
  misc_feature: GYAE6OF02HI57H.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaaactcatgatttatgaggcactaagcggccctcaggggtttctatcgcttctctggctcagagtctggcaacacggcctcctgacaatctctgggctccaggctgaggacgaggcggatttattactgttgctcatatgcgggtagtagctactttcgattgtccttagttcggcggagggaccaagctgaccgtcgtggtcagcccaagctcgccctcgtcactctcgtcccacctcctctacgtctactctgagtcgg

SEQ ID NO: 60972 - DNA, 588 bp, Homo sapiens
  misc_feature: GYAE6OF02JB4JJ.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatccaccatctcctgcactggaaccagcagtgacgttggtggttataactatgtctcctggtaccaacagcacccaggcagacgcccccaaatcatgtatttttgattgtcaactaatccggccctcgtaggggtttctgactcgcttctcgtggctccaagtctgtacctacgaccggtccctccctagaccatcctcgtgggcctccgaggctggacggacgaggctagtatttattattgcagtctcaattataacaagcagcacgcctaccctttctttcgtcgttacgggaaggtcgggaaccgtaaggtccacccgttcctacgtaccgacgacccacggacccaaccccgtacgtctacctacttccgttaccgttacccctacccttcccgtaccgttaccgttcgtactccg

SEQ ID NO: 60973 - DNA, 523 bp, Homo sapiens
  misc_feature: GYAE6OF02FXLGP.12.53.E09.1.454.CMB.1.raw
  modified_base (520)..(520): a, c, t, g, unknown or other
  misc_feature (520)..(520): n is a, c, g, or t
tcagatacgacgtacacgaccggtgctcgatttagagagagtgtgttgggtttgggggctttgcctgggctctgctgctcctcactctcctcactcaggacacagggtcctgggcccaatatgccctgactcagcctgcctccgtgtctgggtctcctggacagtcgatcaccatttcctgcaccggaaccaatagtgacgttggtcgttataactttgtctcctggtacaaacagcacccaggcaaacgccccccaaatcctgatttatgaggtcactattcggtcctcaggtaatttctaatcgcttctctggttccaagtctggcaacacggcctccctgaccatctctggggtccaggctgaggacgaggctgatttattactgcagttcatatacagcacttcactctcgtggtgtcggcggtggacagctgccgtctaagtcagccaaggttcgcccctcgtcactctcgttcccaccctcctctacgtctactctgacgcggctggcaggcgnacg

SEQ ID NO: 60974 - DNA, 525 bp, Homo sapiens
  misc_feature: GYAE6OF02IGMIP.12.53.E09.1.454.CMB.1.raw
  modified_base (270)..(270): a, c, t, g, unknown or other
  misc_feature (270)..(270): n is a, c, g, or t
  modified_base (523)..(523): a, c, t, g, unknown or other
  misc_feature (523)..(523): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagtaatgattttggaaattttgacctagtctcctggtaccaacaataccccggcaaagtccccaagttaatcattttangagggcactaagcggccctcaggatttctgatcgcttctctggctccaaggctggcgaccgggcctccctgacaatatctggctcaggctgaggacgaggctcattactactgctgctcatatggagttatagcacgttgggtgttcggcggcgggacaagtgaccgtacctaagtcacgccaaggcctcgcccctcggtcactctcgttcccaccctcctctaccgtcgtactctgagcggctggcacggcncg

SEQ ID NO: 60975 - DNA, 551 bp, Homo sapiens
  misc_feature: GYAE6OF02G5CU8.12.53.E09.1.454.CMB.1.raw
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccaacagtgatgttgggacttataaccttgtctcctggtaccaacaacacccaggcaaagcccccaaatcatgatttatgagggcactaagcggccctnaggggtttcttatcgcttctctggctccgagtctggcaacncggcctccctgacatctcngggctcaggctgaggacgaggcggattattactgttgctcatatgcgggtagtagcactttcgatgttcctagttcggcggagggaccaagctggaccgtccgtgggtccacggcccaagggctcgccccctcgggtccaccgtcgtccgttcccgcccgtcccttccgtaccgttcgttactccgtcgacggcggtctcggg

SEQ ID NO: 60976 - DNA, 555 bp, Homo sapiens
  misc_feature: GYAE6OF02H6TGU.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaaactcatgatttatgagggcactaaagcggccctcaggggtttcttatcgcttctctggctccgagtctggcaacacggcctccctgacaatctctcgggctccgagctgaggacgaggcggtattatacgtgttgctcatatggcggtagtagcaactttgattgtacctagttcggcggacgggaccaagcctagacccgtcgtggtcacgcccaaggccgtcgcccctcggtctacgtcctcgttccccgcccttcccgtcttaccggtccgttagtacgtgacggcgggtaccgg

SEQ ID NO: 60977 - DNA, 385 bp, Homo sapiens
  misc_feature: GYAE6OF02IPZ3S.12.53.E09.1.454.CMB.1.raw
  modified_base (372)..(372): a, c, t, g, unknown or other
  misc_feature (372)..(372): n is a, c, g, or t
  modified_base (378)..(385): a, c, t, g, unknown or other
  misc_feature (378)..(385): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggcctccaggctgaggacgaggcggattattactgttgctcatatgcgggtagtagcactttcgatgtcctattcggcggaggaccaagctgaccgtcctgggtcagcccaaggctcgccccctcggtcactctcgtcccgccctctctacgtcgtatctgagcggctggcaaggcncatagnnnnnnnn

SEQ ID NO: 60978 - DNA, 561 bp, Homo sapiens
  misc_feature: GYAE6OF02HGPMS.12.53.E09.1.454.CMB.1.raw
  modified_base (271)..(271): a, c, t, g, unknown or other
  misc_feature (271)..(271): n is a, c, g, or t
  modified_base (403)..(403): a, c, t, g, unknown or other
  misc_feature (403)..(403): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaaactcatgatttangaggcactaagcggcctcgagggtttcttatcgcttctctggcctccgagtctggcaacgacggccctcctgacaatctcgtgggcctccaggctggaggacgaggcggattactactgttgctcatatggngggtagtagctactttcgattcgtcctagttcgggacggtagggaccaaggtctacggacccgtcgtcgggtcacgccgaacggtcgtcgtccccgtcggtcaccgtcgttccgttcccgtccctccgtcttaccggtctactcgtgacggtcggtcg

SEQ ID NO: 60979 - DNA, 554 bp, Homo sapiens
  misc_feature: GYAE6OF02IMTH3.12.53.E09.1.454.CMB.1.raw
  modified_base (403)..(403): a, c, t, g, unknown or other
  misc_feature (403)..(403): n is a, c, g, or t
  modified_base (516)..(516): a, c, t, g, unknown or other
  misc_feature (516)..(516): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctggtaccaacaacacccaggcaaagccccaaaactcatgatttatgagggcactaagcggccctcaggggtttctatcgcttctctggctcgagtctggcaacaccggcctccctgacaatctcgtgggcctccgaggctggaggacgagggcggtattatttactgttgctcatatggngggtagtagctacgtttcgattcgtacctagttcgggacggaggaccagcgtagacccgtcgtcggtcacgcccgaacgcgtccgccccgtcgtccaccgtctccgttccccncccttcctcgttacgtcgttctcgtgacggcggtacgg

SEQ ID NO: 60980 - DNA, 532 bp, Homo sapiens
  misc_feature: GYAE6OF02ITLAH.12.53.E09.1.454.CMB.1.raw
  modified_base (506)..(506): a, c, t, g, unknown or other
  misc_feature (506)..(506): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgagggcactaagcggccctcaggggttttcttatcgctttctctggctccgagtctggcaacacggcctcctgacaatctctgggctccaggctggaggacgaggcggatttattactgttgctcatagtggcgggtagtagctacgtttgattgttcctagttcgggcggagggaccaaggcctagaccgtcgtgggtcacgcccaaggctcgcccctggtcacgtcctcgttcccncctcctctcgtctatcgtgcgcggtc

SEQ ID NO: 60981 - DNA, 518 bp, Homo sapiens
  misc_feature: GYAE6OF02IWI02.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgaggcactaagcggccctcaggggtttcttatcgcttctctggctccgagtctggcaacacggcctccctgacaatctctgggctccaggctgaggcgaggcggattattactgttgctcatatgcgggtagtagctactttcgattgtcctagttcggcggaggaccaagctgaccgtctgggtcacgccaaggctcgcccctcgtcactctcgttcccaccctcctctacgtctatctgacgcggtcg

SEQ ID NO: 60982 - DNA, 523 bp, Homo sapiens
  misc_feature: GYAE6OF02GR049.12.53.E09.1.454.CMB.1.raw
  modified_base (494)..(494): a, c, t, g, unknown or other
  misc_feature (494)..(494): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaactcatgattatgaggcactaagcggcctcaggggtttcttatcgcttctctggctccgagtctggcaacacggcctccctgacaatctctgggctccgaggctggaggacgaggcggattattactgttgctcatatgcgggtagtagctactttcgattcgtcctagttcggcggaggaccagctgaccgtcgtggtcacgcccaaggcctcgcccctggtccacgtctcgttcccncctcctctacgtcgtatcgtgagcggtcg

SEQ ID NO: 60983 - DNA, 571 bp, Homo sapiens
  misc_feature: GYAE6OF02F5PV2.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaaccacccaggacaaacgcccccaaaactcatgtatttatgagggcaactaagccgccctcgtaggggtttcttagtcgtcttctcgtggcctccgagtcgtggcaacgaccggcctccctgacatctcgtggcctccgaggctgagggacgaggcggtattagttactgttgctcatatggtcgggttagacgtctactttacggattcgtccttagttcggcgggacggaccgaagctacggaccgtccgtgggcacgacccaaggctccgccccgtcgtccacgtctccgttccctccctcctccgtacgttcgtactcgtcggacggtcggcg

SEQ ID NO: 60984 - DNA, 525 bp, Homo sapiens
  misc_feature: GYAE6OF02GIPUF.12.53.E09.1.454.CMB.1.raw
  modified_base (388)..(388): a, c, t, g, unknown or other
  misc_feature (388)..(388): n is a, c, g, or t
  modified_base (458)..(458): a, c, t, g, unknown or other
  misc_feature (458)..(458): n is a, c, g, or t
  modified_base (494)..(494): a, c, t, g, unknown or other
  misc_feature (494)..(494): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaaactcatgatttatgagggcactaagcggccctcaggggtttctatcgcttctctggctccgagtctggcaacacggcctccctgacaatctctggctcaggctgagacgaggcggtattatactgttgctnatatgcgggtagtagctactttcgattcgtccttagttcgggcggaggaccagcgtgaccgtcgtggtcncgaccgaggcctcgcccctcgtcactctcgttcccncccttcctctacgtctactctgtcgcggtcg

SEQ ID NO: 60985 - DNA, 734 bp, Homo sapiens
  misc_feature: GYAE6OF02II389.12.53.E09.1.454.CMB.1.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
tcagatacgacgtacacgaccggtgctcgatttagagagagtgtgttgggtttgggggcgtttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataacttgtctctggtacaacaacaccaggcaaacgccccaaatcatgattangaggcactaagcgcctnagggtttctatcgcttctctggctccgagtcgtcggacaaacgcggccctcctacgacaactctcgtgggtcctccgagcgtgacgggacgacgggacgtatttacgttacgtggtttcgctactagttagtcgggtacgggttaggtacgtaccttaccgttttacgaacgttcggtttacccttaacggtttccggggacggggtaaccggggtaaacccgtaacgggttccggtaccggttaaccccggttccgggttacggggttacccgtaaccgggaccccgtaaaccgggtccgttacccgggccccccccggtttacgggtacccgttacccgttccccgtttcccgggtttccccccgtacccccgtttaccccgtttcccgttaacccgggtttccgttaaccgtttccggtaacggtacccggggttcccgggttcccgggg

SEQ ID NO: 60986 - DNA, 542 bp, Homo sapiens
  misc_feature: GYAE6OF02IX0P2.12.53.E09.1.454.CMB.1.raw
  modified_base (331)..(331): a, c, t, g, unknown or other
  misc_feature (331)..(331): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggttttcttatcgcttctctggctccgagtctggcaacncggcctccctgacaatctctgggctccaggctgaggacgaggcggatttattactgttgctcatatggcgggtagtagctactttcgattgtccttagttcggcgggacgggaccgaagctcgaccgtccgtgggtcacgcccgaaggctcgccccctcggtccaccgtctcgttcccgccctcctctacgtcgtactcgtgacgcggtcg

SEQ ID NO: 60987 - DNA, 751 bp, Homo sapiens
  misc_feature: GYAE6OF02JX1WM.12.53.E09.1.454.CMB.1.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
tcagatacgacgtacacgaccggtgctcgatttagagagagtgtgttgggtttgggggcgtttgtcctgggctctgctgctcctcactctcctcactcaggacacagggtcctgggcccagtctgccctgacctcagcctcgcctccgtgtctgggtctccgtggacagtcgatcaccatcctcctgcacgtcgggaccagcagtgatgttggacttatacttntctctgtaccacacaccagacaacncccaacncatgattanagaggcactaagcgcctcgaggtttctatccgtcttcgtntcggcctccgtagttctcgggctaaaccgccgggtaccctccgtacgaccaacgtcctcggtggtccttccggacggtcgtaggaacggacgggtaaggggccgtaaagttttacgtacgttggtcgtcgttactaaagttaggtacgggtccggggttaagtaccgttcgtaccgttttaccggagtttcggttaacccgtttagtttaccccggggggacgggtaacgggaaaccccgttaaaggggttccctccggggttaaccccggttacgggtcggggttacccgaacccgggtacccgtaaaccgggccgtttcccgaccccccggtttggtaaccctccccgtttccgttaaccccggtttaccccctaccccctttcccgttacccgtttaacgggttcccgttagttccccgacgggttaccgggcccggtccggg

SEQ ID NO: 60988 - DNA, 544 bp, Homo sapiens
  misc_feature: GYAE6OF02HQKL8.12.53.E09.1.454.CMB.1.raw
  modified_base (266)..(266): a, c, t, g, unknown or other
  misc_feature (266)..(266): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataacttgtctcctggtaccaacaacaccaggcaaagcccccaaatcatgatttangaggacaaaaacggccctacggggattctaatcgcttctctggctccaagtctggcaacacggcctcctgacatctctggctcaggctgaggcgagctgattatactgctgctcatatgctaggtagtagctacttgattcgtcctagtcggcggacgggacaagcgtacgaccgtcgtcggtaccacgacccgaacggcctccggtccccctcggtaccaccttcccgtcgttccccgcccttccgtaccgttacgtcgtactcgtcgcggtccggg

SEQ ID NO: 60989 - DNA, 721 bp, Homo sapiens
  misc_feature: GYAE6OF02JAWEM.12.53.E09.1.454.CMB.1.raw
  modified_base (299)..(299): a, c, t, g, unknown or other
  misc_feature (299)..(299): n is a, c, g, or t
tcagatacgacgtacacgaccggtgctcgatttagagagagtgtgttgggtttgggggctttgccgtggctctgctgctcctcactctcctcactcaggacacgacgggtccgtcgggcccagtctcgccctgactcagcctgcctccgtgtcgtgggtctccgtggacagtcgatcacctatcctcctgacacgtcgggaccagcagtgagttggttgggtacttaataaccttgtcctccgtcggtaaccaaacaaccacccgaggaccaaaccgacccccaaatcatagtatttanggaggacaacgtaacggccgcctagttagggtttcttacgtcgtcttcgtcgtcggcctcggtacgtcgtggaccaaccgaccggtcccctcctagactaactcgtcggtcggcctccgaggtcgtaggacgggacggagggacggtaattttacgttacgtggttacgctacgtagttagtcgggtacgggtaagtacgccgttattcgtagtttcgttaccttagttccggggacggacgggtaccaaggtccgtacggtacccgttacggttcgggacctaccgggaccgaaacggtccgtacccgtcccccggttcggacctaccgtttccgttcccggtttcccccgtaccccgtttcccttacggttacccggtttacgttaccgttcggtacgggtacggggtcccggttacggg

SEQ ID NO: 60990 - DNA, 385 bp, Homo sapiens
  misc_feature: GYAE6OF02IQR8D.12.53.E09.1.454.CMB.1.raw
  modified_base (377)..(385): a, c, t, g, unknown or other
  misc_feature (377)..(385): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtatagcactttcgatgtcctattcggcggaggaccaagctgaccgtcctgggtcagcccaaggctgccccctcggtcattctgttccccgcctcctctacgtcgtatctgagcggctggcaaggcgcagtagnnnnnnnnn

SEQ ID NO: 60991 - DNA, 530 bp, Homo sapiens
  misc_feature: GYAE6OF02GVKZI.12.53.E09.1.454.CMB.1.raw
  modified_base (270)..(270): a, c, t, g, unknown or other
  misc_feature (270)..(270): n is a, c, g, or t
  modified_base (519)..(519): a, c, t, g, unknown or other
  misc_feature (519)..(519): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttangaggcactaagcgccctcgaggggtttctatcgcttctctggctccgagtctggcaacacggcctcctgacatctcgtgggctccgaggctggaggcgagggcgtattatactgttgctacatatcggcgggtagtagctacttcgtattcgtctagttcggcgggaggaccaagctcgaccgtccgtgggtcacgccaaggctcgcccctcggcactctcgttcccaccctcctactcgtcgtactcnggtagcggtcg

SEQ ID NO: 60992 - DNA, 539 bp, Homo sapiens
  misc_feature: GYAE6OF02F9686.12.53.E09.1.454.CMB.1.raw
  modified_base (527)..(527): a, c, t, g, unknown or other
  misc_feature (527)..(527): n is a, c, g, or t
  modified_base (535)..(535): a, c, t, g, unknown or other
  misc_feature (535)..(535): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttctatcgcttctctggctccgagtctggcaacacggcctccctgacaatctctgggctccaggctgaggacgaggcggattattactgttgctcatatggcgggtagtacgctacgtttcgattcgtccttagttcgggcggtacgggaccaagctacgaccgtcgtgggtacacgcccaaggctccgccccgtcgtcactctcgttcccgtcctcctcttacgtcgttcngacgcggntcgg

SEQ ID NO: 60993 - DNA, 525 bp, Homo sapiens
  misc_feature: GYAE6OF02HWUOK.12.53.E09.1.454.CMB.1.raw
  modified_base (390)..(390): a, c, t, g, unknown or other
  misc_feature (390)..(390): n is a, c, g, or t
  modified_base (462)..(462): a, c, t, g, unknown or other
  misc_feature (462)..(462): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaaagcccccaaaactcatgatttatgagggcactaagcggccctcaggggtttctatcgcttctctggctccgagtctggcaacacggcctcctgacaatctctgggctcgaggctggagacgaggcggtattatactgtgctnatagtgcgggtagtagctactttcgattgtccttagttcggcggagggaccaagcctagaccgtctgggtcngcccaggctcgcccctgcacgtctcgttcccgcccttcctctacgtctatcgtgacgcggtcg

SEQ ID NO: 60994 - DNA, 569 bp, Homo sapiens
  misc_feature: GYAE6OF02JI0Z7.12.53.E09.1.454.CMB.1.raw
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctnaggggtttcttatcgcttctctggctccgagtctggcaacncggcctccctgacaatctntgggctccaggctgaggacgaggcgattatactgtgctcatatggacggtagtagctactttcgattgtcctagttcggcggtaggaccaagcttacgccgtactcgggtcacgcccgaaggcccgtaccgtccccgtacgtcctaccgttcgttccgtacccctacccgttccttaaccgtacgttaccgtacttccggtacggtaccggtcggtaccgg

SEQ ID NO: 60995 - DNA, 520 bp, Homo sapiens
  misc_feature: GYAE6OF02IV9JC.12.53.E09.1.454.CMB.1.raw
  modified_base (270)..(270): a, c, t, g, unknown or other
  misc_feature (270)..(270): n is a, c, g, or t
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttangagggcactaagcgccctgaggggtttcttatcgcttctctggctccgagtctggcaacncggcctccctgacatctctggctcagctgaggcgaggcgtattatactgttgctnatgtggcgggtagtgctacgtttcgattcgtccttagttccgggcggaggaccaagcgtacgaccgtccgtggtcacgcccagctcgcccctgcactctcgttcccacctcctctcgtcgtancngacggcggtc

SEQ ID NO: 60996 - DNA, 599 bp, Homo sapiens
  misc_feature: GYAE6OF02HQPW0.12.53.E09.1.454.CMB.1.raw
  modified_base (266)..(266): a, c, t, g, unknown or other
  misc_feature (266)..(266): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacaccagcaaacgccccaaatcatgatttangaggcactaagcggccctcgtagggtttcttatcgtcttctctcggctccgagtctcgcaacacggcctcctgacatctctgggctcgagctggaggacgaggcggtatttagttacgtgttcgcctctagttagtgggtcgggttaagtcgtacttaactttcggattcgtccttacgttcgggacgggacggtaccagtccgtacgaccggtccgttgggccgacgacccgaaggtcccgtccgaccccgttcggtcctaccgtccgttccgttccccgcccttcccgtcgttacccgtcgttaccttcggtacggtacggtcggtaccgg

SEQ ID NO: 60997 - DNA, 581 bp, Homo sapiens
  misc_feature: GYAE6OF02IJ8BY.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctctggtaccaacaacacccagcaaagcccccaaatcatgatttatgaggcactaagcggccctcaggggtttctatcgtcttctctggctccgagtctggcaacgaccggccctcctgacaatctcgtgggcctccaggctggaggacgaggcgtattattactgttgctacataagtggacgggttagtacgctacttttagattcgtccttagttccgggcggacggaaaccagctacggtacccgtccgtgggtcacgacccaaggcctaccgcccccttggtcctaccgttcgttccgttaccccctacccctccttaccgttaccgttcgttactccgtaggtacggtcgggtccg

SEQ ID NO: 60998 - DNA, 171 bp, Homo sapiens
  misc_feature: GYAE6OF02HYSNO.12.53.E09.1.454.CMB.1.raw
tcagatacgacgtacacgaccggtgctcgatttagagagagtgtgttgggtttgggggaagaggaagactgacggtccccccaggagttcaggtgctgggcacagcggccctgggctgcctggtcaaggactacttcacgtcgtatctgagcgggctggcaaggcgcatag

SEQ ID NO: 60999 - DNA, 596 bp, Homo sapiens
  misc_feature: GYAE6OF02JMML3.12.53.E09.1.454.CMB.1.raw
  modified_base (392)..(392): a, c, t, g, unknown or other
  misc_feature (392)..(392): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggacaaagcccccaaactcatgatttatgagggcactaagcgccctcgaggggtttcttatcgcttctctggctccgagtctggcaacacggccctccctgaccatctctcgggctccgagctgaggacgaggcggtatttatactgtcnctcatgtgtcgggtagtagctactttcgattcgtaccttgttccgggtcggacgggaccgaacgtcgtacgacccgttcgtacgggtacgacgcccgaacggtccgtccgacccccgttcggtcctacgttccgttccgtttcccctacccgtttaccctcgttaccggttcgttaccgttcgtacggtcgggtacgggtccgg

SEQ ID NO: 61000 - DNA, 528 bp, Homo sapiens
  misc_feature: GYAE6OF02GSLV9.12.53.E09.1.454.CMB.1.raw
  modified_base (381)..(381): a, c, t, g, unknown or other
  misc_feature (381)..(381): n is a, c, g, or t
  modified_base (492)..(492): a, c, t, g, unknown or other
  misc_feature (492)..(492): n is a, c, g, or t
tcagatacgacgtacacgaccggtgctcgatttagagagagtgtgttgggtttgggggcgtttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggaccaaagcccccaaatcatgattatgaggcactaagcgcctcagggtttctatcgcttctctgctcgatctggcaacacggcctcctagacaactctctgggctccgaggctgagacgaggcggtattatactgtnctctatactgcgggtagtagctacttcgattcgtcttagtcggcggaggaccaagctcgaccgtcgtggtcgagcccgaaggctcgcccctgcctacgtctccgttacccncccttctaccgtacgttcgtctcgcgtacgcggtcg

SEQ ID NO: 61001 - DNA, 380 bp, Homo sapiens
  misc_feature: GYAE6OF02HNDY4.12.53.E09.1.454.CMB.1.raw
  modified_base (359)..(359): a, c, t, g, unknown or other
  misc_feature (359)..(359): n is a, c, g, or t
  modified_base (376)..(380): a, c, t, g, unknown or other
  misc_feature (376)..(380): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtctgggtcagcccaaggctcgccccctcggtcactctgttccccgcccttcctctacgtcgtatctgngcggctgcagcgcatgnnnnn

SEQ ID NO: 61002 - DNA, 620 bp, Homo sapiens
  misc_feature: GYAE6OF02I00WN.12.53.E09.1.454.CMB.1.raw
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcacgtgggaccaggcagtggatggttgggaccttataaccttgtctcctggtaaccaacacacccaggcaaacgccccaaatcatgattatgaggcactaagcgcctgagggttctancgtcttctctggctcgngtctggcaacgcggcctcctgacaatctcgtgggactaccgtagctaggacggacgtacggcggtaatttacgtaacgttgttcgctactagtacgtggtacggtagtagacgtaacgtttacgagttcgtacgttagttaccggaggtacggaccgaagtcggtacgtaccggtcgtacgggtacgtacgacccgtaaacggtcgtcgcccccggtaggtaccgtacccgtcgtaccggttccccgtacccgttaccgtaccgtaaccggtttcgtacctcggtacggtacggcgggttccgg

SEQ ID NO: 61003 - DNA, 397 bp, Homo sapiens
  misc_feature: GYAE6OF02JACHR.12.53.E09.1.454.CMB.1.raw
  modified_base (380)..(397): a, c, t, g, unknown or other
  misc_feature (380)..(397): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtatagcactttcgatgtcctattcggcggagggaccaagctgaccgtcctgggtcagcccaaggctgccccctggtcactctcgttcccaccctcctctacgtcgtatctgagcggctgggcaacggcgcatagcnnnnnnnnnnnnnnnnnn

SEQ ID NO: 61004 - DNA, 542 bp, Homo sapiens
  misc_feature: GYAE6OF02GEXW4.12.53.E09.1.454.CMB.1.raw
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (463)..(463): a, c, t, g, unknown or other
  misc_feature (463)..(463): n is a, c, g, or t
  modified_base (488)..(488): a, c, t, g, unknown or other
  misc_feature (488)..(488): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgagggcactaagccggcctcgaggggtttctatcgcttctctggctccgagtcnggcaacncggcctccctgacatctgtggctcgaggctggaggacgaggcggtattacttactgttcnctnatagtggcgggtagtacgctactttcgattgtccttagtccggcggaggaccagcgtgaccgtcgtggtcncgaccaggctccgcccctcggtccncgttctccgttcccacccttccgtcttaccgtcgtactctcggacggtcggtcg

SEQ ID NO: 61005 - DNA, 787 bp, Homo sapiens
  misc_feature: GYAE6OF02G8DJ4.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccattctctgcacgtcggaccagcagtgagttgggttacggtacttaacttaaccgtttcgtccttccgtacggtaaccaaaccaacccaacccgacggaaccaacccgaaccccctaaactccagtagttaattttagagggacgggacctaaacgtaacggccccggtaccctacgggttacgggttttacttacgtccgttcctttcgtcgtcggtcctaccggtacgttcgtcggaccaacgaccggtcccctccgtacgaactaactcctcggtcggtcctaccggacgtcgtaggacggaacgggacgggacggttaattttaacgtttacgttggttcgtacctactaagttacgtcggggtacgggttaagtacgtaccgtttacgttacgtagttccgttaccgtttacgggttccggggacgggtaaccggaaccgaacggtccggtaaccggttaccccggtcgggttacgggtaccgacccgaccggtaacgtccgccccgttccccggtacggtcctacccgttccgttccccgttacccctccccgtttcctaccggttaccgttacgtcttaccggtacgggtaccgggtccggtaccggg

SEQ ID NO: 61006 - DNA, 580 bp, Homo sapiens
  misc_feature: GYAE6OF02GY1L5.12.53.E09.1.454.CMB.1.raw
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggacaaacgacccccaaactcatgatttatgaggcactaagccggcctcgaggggtttcttatcgtcttctcgtggctccgagtctgcacncggcctccnacatctcncggctcgagctgacggacgnggcgtattatacttgtnctnatgtggtcggtagtacncgtacttcgattcgtcgttagtcggacgggacggaccgaagcgtacgtccgtcgtcggtcacgaccgaaggtcctacccgtccccgtcggtcctaccgttccgttcccttcccctacccttcccgttaccgttaccggttccgttactaccgttacggaccgggtcggtccgg

SEQ ID NO: 61007 - DNA, 397 bp, Homo sapiens
  misc_feature: GYAE6OF02I4KBY.12.53.E09.1.454.CMB.1.raw
  modified_base (377)..(397): a, c, t, g, unknown or other
  misc_feature (377)..(397): n is a, c, g, or t
tcagatacgacgtacacgaccggtgctcgatttagagagagtgtgttgggacgttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggtattattactgttgctcatatgcgggtagtagctatttcgatgtcctattcggcggaggaccaagctgaccgtctaggtcagcccaaggctcgcccctggcactctcgtcccaccctcctctacgtcgtatctgacgcggctggcaaggcgacatgnnnnnnnnnnnnnnnnnnnnn

SEQ ID NO: 61008 - DNA, 657 bp, Homo sapiens
  misc_feature: GYAE6OF02GZD72.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatggttgggacttataaccttgtctctggtaccaacaacaccagacaaacgccccaaatcatgatttatgagggcactaagcggcctcgtaggggtttcttatcgctttcgtcgtggcctaccggagtctcggctaacgcggtccctcctagaacaatcgtcgtagggctaccgagtcgtaggaggaacgaggacggtatttacgttaacgtcgtttagcttacgaagttactacgggtacgggtaacgtaggtaccttaacgttttcggaattcgttaccgttacgttcgggacgacgggtaccgacgtcgtacggaccgtcgtagggtacacggttacccgaacggtccgttccgacccccgttcgtaccgtaaccgttccggttaccctttaccccgccccgttaccgttccgttaaccgttcgttaaccttcggtacggtacggacccgggtcgg

SEQ ID NO: 61009 - DNA, 603 bp, Homo sapiens
  misc_feature: GYAE6OF02FGH9F.12.53.E09.1.454.CMB.1.raw
  modified_base (270)..(270): a, c, t, g, unknown or other
  misc_feature (270)..(270): n is a, c, g, or t
  modified_base (331)..(331): a, c, t, g, unknown or other
  misc_feature (331)..(331): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgctcctggtaccaacaacacccaggacaaacgcccccaaactcatgatttangagggcactaagcggccctcgtagggtttcttatcgcttctctgctccgagtctggcaacnccggcctcctgacatctcgtgggcctccgaggcctggacggacggacggtacgggtaattttaacgttacgttggtttcgtctactattagttggtacggggtagtacgtctacgttcgtagttcgtaccttacgttccgggcgggtacggaccgagtcgtcgaccgtccgtggtacacgccaacggtcctccgccccgttcgccacgttccgtccgttcccctccccgttcctccgttaccgttcgttacctcgtacggcggtcgggtacg

SEQ ID NO: 61010 - DNA, 826 bp, Homo sapiens
  misc_feature: GYAE6OF02HFSCY.12.53.E09.1.454.CMB.1.raw
  modified_base (264)..(264): a, c, t, g, unknown or other
  misc_feature (264)..(264): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgtatcaccatctcctgcactgggaccagcagtgatgttgggacttatacttgtctctgtaccaacaacaccaggacaacgccccaaatcatgatttangaggcactaagccggcctacgtagggtttacttactcggtctttactcgtacggccttccggagttccgttggaccaaccgaaccgggtcccttacccgtaggtaaccaacgttcctacgtcgggacccttacccgagggtaccgttggaaccggggaacggtaacgggtaccgggtaacttttaacggtttaactttgggttacggtacctttacgtaacgtttaagtcgggtaacggggtttacggtaacgttacccgtttaacgtttttaccggtaagtttaccgggtttacccctttaacggttttccgggggaacccggggttaaccggggaaacccgtaacggtcccgggttaaccgaaccccggtttccgggtaacgggtttacccgaacgggtacccccggtaaagggtcccgttacccggacccccccgtttacgggtacccgttacccgttcccggtttacccgttacccccgtaccccgtttccccgtacccgtttacccggtttaccttaccgttaacccggttcgggaccggttacccggggacccggg

SEQ ID NO: 61011 - DNA, 562 bp, Homo sapiens
  misc_feature: GYAE6OF02GQ1LW.12.53.E09.1.454.CMB.1.raw
  modified_base (232)..(232): a, c, t, g, unknown or other
  misc_feature (232)..(232): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactggacagcagtgatgttgggacttataaccttgtctcctggtaccaanaacacccaggcaaacgccccaaactcatgatttatgaggcactaaagcgcctcaggggtttcttatacgcttctcgtgctccgagtctggcaacnccggctcccngacaatctntgctcagctgagacgaggcggtattacttactgtagctctaatangtacgggtagtaggtctactttcgattcgttacctagttcggcgggacggtaccaagcgtcgaacccgttcgtcggtacacgtcccgaaggtccgtaccgcccccttcggtcctaacgtcctccgttcccgaccccttacgtcctacgtccgtatccgtgacgtcgtccgg

SEQ ID NO: 61012 - DNA, 600 bp, Homo sapiens
  misc_feature: GYAE6OF02GM110.12.53.E09.1.454.CMB.1.raw
  modified_base (269)..(269): a, c, t, g, unknown or other
  misc_feature (269)..(269): n is a, c, g, or t
  modified_base (328)..(328): a, c, t, g, unknown or other
  misc_feature (328)..(328): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaatcatgatttangaggcactaagcggccctgagggtttcttatcgcttctctggctccgagtctggcaacncggctcctgacatctctggctcgaggctgaggacgaggcggattattactgttgctcatatggtacgggtatagctacgtttcgattcgtaccttagttccgggacggaggaacccaagtccgtacggacccgttccgtcgggttaccacggacccgaaggcctacccgtccccgttcggtcctaccgttcccttccggtttacccccaccccgtttcccttaccgttaaccggttccgttaacgttccgtacgggtacgggccgggtacgg

SEQ ID NO: 61013 - DNA, 590 bp, Homo sapiens
  misc_feature: GYAE6OF02ITH4Y.12.53.E09.1.454.CMB.1.raw
  modified_base (319)..(319): a, c, t, g, unknown or other
  misc_feature (319)..(319): n is a, c, g, or t
  modified_base (401)..(401): a, c, t, g, unknown or other
  misc_feature (401)..(401): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctctggtaccaacaacaccaggcaaacgccccaaactcatgatttatgagggcactaagccggccctcgacgggtttcttatcgtcttctctggctcgngtctggcaacgaccggcctcctcgacatctcgtgggcctccgaggctaggacggacggaggcggtattagttactgttgctntagtatggaggtagtagctacgttcgattgtcttagttcggcggtacggaccgaagtcgtacgtaccgtcgtacgggtcacgccgaacggtcctaccgtccccgtccgtacctacccgttccgttcccgttccccgtccccttacccgttccgttaccgtcgttactccggtacggcggtccggtccgg

SEQ ID NO: 61014 - DNA, 606 bp, Homo sapiens
  misc_feature: GYAE6OF02GXM5B.12.53.E09.1.454.CMB.1.raw
  modified_base (332)..(332): a, c, t, g, unknown or other
  misc_feature (332)..(332): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccagacaaacgcccccaaactcatgtatttatgagggcaactaagccggtccctcgtaggggtttcttactcgtcttctcgtcggcctccggngtctggcaacgaccgcctccctgacaactcgtcgtgggtcctccgaggtcgtaggacggacggacggacggtatttacttacgttgtcgtctactatagtggtcgggtagtagtctacgttcgtagttcgtaccgttacgtcggcgggacggacgacgcgtccgtaccgtccgtcggtcgaccgccgacgcgtcccgcccgtccgtacaccgttccgtccgttccccgtccctcccgttacctaccgggttctcgttctcggtcggtcggtcgg

SEQ ID NO: 61015 - DNA, 554 bp, Homo sapiens
  misc_feature: GYAE6OF02FFTGA.12.53.E09.1.454.CMB.1.raw
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
  modified_base (493)..(493): a, c, t, g, unknown or other
  misc_feature (493)..(493): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcagacgccccaaactcatgtattttgatgtcactaatcggccctctaggggtttctgatcgcttctctgctcgaatctgactacgcgtcctcctgaccntctcgtggctcgagctgacgacgaggctgtattattatcgcagctanacttatacaagcagacacgcctacccttcttttcgtacgttacgggaagtacgggacctaagggtccacccgttctacgtcacgacccgaacggcccaacccncttcgtaccaccgttccttccgtccccgtcccttccgtaccttacgtccgtatccgtacgg

SEQ ID NO: 61016 - DNA, 678 bp, Homo sapiens
  misc_feature: GYAE6OF02ISA40.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctcaggggtttcttatcgcttctctggctccgagtctggccaacgcggcctccctgacaatctcgtcgggcctccgaggctggaacggacgaggcggtaatttacgttacgtgttgcctacatagtggtacgggtaagtacgctaaccgttttcgacgttcgttacccgttagttccgggccgggtaacgggtacccaaggccgttacggtacccggttccgttcgggggtaccaccgggtaccccgtaaacgggtccgtacccggtccccccgttacgggtcccttaaccggttcccgtttaccccggttcccccgtacccccgttcccgttaacccgtttaccggttccggttaaccgttcccgtacgggtaccgggtcccgggtaccggg

SEQ ID NO: 61017 - DNA, 603 bp, Homo sapiens
  misc_feature: GYAE6OF02GUGW5.12.53.E09.1.454.CMB.1.raw
  modified_base (388)..(388): a, c, t, g, unknown or other
  misc_feature (388)..(388): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctggtaccaacaacacccaggacaaacgcccccaaactcatcgatttatgaggcataagcgcctgagggtttctatcgtcttctcgtgctccgagtctggccaacacggcctcctgacaatctcgtggcctcgagctgagacgaggcgtattattactgtcgctanattagtggcgggtagtagtactactttcgattcgtaccttagttccgggcggtaacgggacctaagccgtacggacccgttcgtcgggacgtacgacccgaaggtccgtccgacccccgtcggtacctaccgtttccgtccggttacccccttaccccgttcccgtaccgttaccggttccgttaacgttccgtacggtaccggccgggtaccgg

SEQ ID NO: 61018 - DNA, 525 bp, Homo sapiens
  misc_feature: GYAE6OF02F7YNM.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggccaaagcccccaaactcatgattatgagggcactaagcggccctcaggggtttcttatcgcttctcgtggctccgagtctggcaacgacggcctcctgacaatctctgggctccgaggctggacggacgaggccggattattactgttgctcatatgcgggtagtcggctactttcgctacgtattcggcggtaggaccaaggctcgaccgtcctacgtcagccaagctcgcccctgtcactctcgtcccctctctacgtcgtctctcgagcggctggacg

SEQ ID NO: 61019 - DNA, 518 bp, Homo sapiens
  misc_feature: GYAE6OF02I4LPN.12.53.E09.1.454.CMB.1.raw
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (374)..(374): a, c, t, g, unknown or other
  misc_feature (374)..(374): n is a, c, g, or t
  modified_base (505)..(505): a, c, t, g, unknown or other
  misc_feature (505)..(505): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggacaaacgcccccaaactcatgatttatgagggcaactaagcggccctcgaggggtttctatcgcttcnctggctccgagtctggcaacncggcctccctgacaatctctgggcctcgaggctgaggacgnggcgtattattactgttgctcatagtggcggtagtagctacgttcgatgtcttagttcggcggaggacagctcgacgtctggtcacgccgagctcgccctgcactcttccgtcctacctcctctcgtctanctggacgcggtcg

SEQ ID NO: 61020 - DNA, 657 bp, Homo sapiens
  misc_feature: GYAE6OF02G28VO.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcaacgtaagccggccctcaggatttctgatcgcttctctggctccaaggctggccgaccggtcctccgtgactaatactcgtgggcctaccgaggcgtggaacggacgacggtctacgtaacttacgactcgctagtcctactagtagtacggggtaagtttactacgtcgtacggtttggggttacggttccgggaccgggtacgggaaccgaaacggttaccgggtaacccgttcgttaaacgccgtaaccgacccgaacggtcccgttccgcccccgttacggtccctaccgttaccgtcccgttacccctaacccgttccccgttaccgttaccggttccgttacgtcccgtggtaaccggtccgggtacgtaccggg

SEQ ID NO: 61021 - DNA, 588 bp, Homo sapiens
  misc_feature: GYAE6OF02HEMDR.12.53.E09.1.454.CMB.1.raw
  modified_base (340)..(340): a, c, t, g, unknown or other
  misc_feature (340)..(340): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaatcatgattatgagggcactaagccggccctcgaggggtttctatcgcttctctggctccgagtctggcaacacggccctccngacaatctcgtggcctccaggctggaggacgaggcgtattagttactgtgctcatatggacggtagtagctactttcgattgtccttaagttcgggacggacggacctaaggcgtcgaccgtccgtagggtcacggcccgaacggcctccggcccccgttcggtcctaccgttcgttccgttacccctaccccgttcccgttacgttaccgtttccggtactttaccgacggtaccggccgggtaccg

SEQ ID NO: 61022 - DNA, 645 bp, Homo sapiens
  misc_feature: GYAE6OF02GS2JT.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttaggaaattttgacctagtctcctggtaccaacaactaccccggacaaacgtccccaagttaactctattttatggagggacactaacggccggacccctcgaggtagtttctgactcgtcttctcgtcggctaccgaggcgtcggccgacccgggtcctacccgtgaactaattacgtcgtcgggtcctccgaggtctaggacgggacggaggtcctacgtaagttacctacgtcgtcctgtcctactagtaggtagggtagttatagtactaggttgggtcgtcgggacggaccgggaaccgtaaggtcgaccgttactaacgtcgacgaccgaggcctcccgtcccgtacgtcctactccttaccgtcccctaccttccttccgtaccgtacttcttcggtacggacggtccggtcgtcggaccgtacgggccagtacg

SEQ ID NO: 61023 - DNA, 401 bp, Homo sapiens
  misc_feature: GYAE6OF02GJF7A.12.53.E09.1.454.CMB.1.raw
  modified_base (381)..(401): a, c, t, g, unknown or other
  misc_feature (381)..(401): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtatagctactttcgatgtcctattcggcggaggaccaagctgaccgtcctgggtcagcccaaggctcgccccctggtcactctcgttcccaccctctctacgtcgtatctgagcggtctgggcaaggccgcatagcnnnnnnnnnnnnnnnnnnnnn

SEQ ID NO: 61024 - DNA, 576 bp, Homo sapiens
  misc_feature: GYAE6OF02JGH95.12.53.E09.1.454.CMB.1.raw
  modified_base (276)..(276): a, c, t, g, unknown or other
  misc_feature (276)..(276): n is a, c, g, or t
  modified_base (414)..(414): a, c, t, g, unknown or other
  misc_feature (414)..(414): n is a, c, g, or t
tcagatacgacgtacacgaccggtgctcgatttagagagagtgtgttgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcagacgcccccaaatcatgatttttgatgtcactaatcggcctnaggggtttctgatcgcttctctggctaccaagtctgactacgacgcctccctgaccatcctctggctccgaggtctaggaggacgaggtctagtaatttattattgcagctacatataacaagcagcagccacccttntttcgtcgttacggaagtacgggacctaaggtccaccgttacctacgtaccacggtcccaaggtccccaaaccccgcgtaccgtaccaccttccgtaccgtttaccccacccttccttccgttaaccgtgttacctcgtacgacggtcgggtctaggaaccg

SEQ ID NO: 61025 - DNA, 635 bp, Homo sapiens
  misc_feature: GYAE6OF02HVSN3.12.53.E09.1.454.CMB.1.raw
  modified_base (268)..(268): a, c, t, g, unknown or other
  misc_feature (268)..(268): n is a, c, g, or t
  modified_base (407)..(407): a, c, t, g, unknown or other
  misc_feature (407)..(407): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcacgtgggaccagcagtgatgttgggacttataacttgtctctgtaccaacaacaccaggacaaacgaccccaaactcatgatttangaggcactaagcggcctgtagggtttctatcgtcttctcgtggtcctccgagtctggacaaccgaccggccctcctgaacaactctcgtgggcctcgaggctaggaggacgaggtctgtaatttattactgactgactnaattatgacgtaagggtagtcggacttacgtttaccgacgtaacgttacgtcgggaccgggtaagggaacctaagcgttacgaacccgttcctaaccgtccgaacgacccgtaacgggtcctccccggtacccccgttcgggtaacccttaaccgttccgttacccgttcccccgtccccttacccgttaccgttaaccgttccgttacttacggtacggtaccgggg

SEQ ID NO: 61026 - DNA, 578 bp, Homo sapiens
  misc_feature: GYAE6OF02GPQT5.12.53.E09.1.454.CMB.1.raw
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (426)..(426): a, c, t, g, unknown or other
  misc_feature (426)..(426): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttangaggcactaagcggcctnaggggtttcttatcgcttctcgtcggcctcgagtctggaccaacgacggcctccctgaccaatctcgtgggcctcaggctggaggacgaggctgtatttattatgcagctacatactacaagcacgcacgtccacccttntttcgtcttacgggaagtcgggaaccgaacggtccaccgtacctacgtacaccgtacccgaaacggacccaacccgactcggtacctaccttccttcgttcccctacccgttccttaccgttaccgttccgttactcgttacgacgtccggg

SEQ ID NO: 61027 - DNA, 588 bp, Homo sapiens
  misc_feature: GYAE6OF02HC6TE.12.53.E09.1.454.CMB.1.raw
  modified_base (341)..(341): a, c, t, g, unknown or other
  misc_feature (341)..(341): n is a, c, g, or t
  modified_base (475)..(475): a, c, t, g, unknown or other
  misc_feature (475)..(475): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacaccaggacaaacgacccccaaactcatgtatttatgaggcactaagcggcctcgagggtttctatcgcttctctggctccgagtctggcaacgacggcctccgnacaatctcgtggcctcgagctggacggacgacggcgtattactttacgtgttgctactatagtggtagggtagtacgtactacgtttcgattcggttacttagtcggacggacggtacagctacggaccgtcgngggtacacgcccgtaaggccgtaccgtccccgtcggtcctacgttccgttaccgtccccgtacccttcccgttccgtacgttacgttctccggtacggtacggtaccggtcgg

SEQ ID NO: 61028 - DNA, 683 bp, Homo sapiens
  misc_feature: GYAE6OF02HI7Q0.12.53.E09.1.454.CMB.1.raw
  modified_base (279)..(279): a, c, t, g, unknown or other
  misc_feature (279)..(279): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgattaagtttgtctcctaggtaccaacatccacccgaggaccaaacgcccccagactcattgtatttagnggacggcaacgtaacggccggccccttaggtacggggttttacctttagtccgttcttctcgtcggcctccgagtcgtcggacaaccgacggccctccgtacgaactactcgtcgtcggctccgaggtcgtaggacggacgagggtacgtaatttacgttacgtgttcgtactagtaagttacggacgggtacggggttaactaggtacctttacgtttacgtacgtttcgtacccttagggtccgggaacgggtaacggtaaccgtaggtccgttacggaccgttcccgggtacggtaccaccggtaccgtaacggccgttccccgtaccccgtccggtacctaccgttcccttcccgttacccctaccccgttccttccggttaccgttcggttactacggg

SEQ ID NO: 61029 - DNA, 737 bp, Homo sapiens
  misc_feature: GYAE6OF02JPVMR.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgccccaaactcatcgatttatgaggcactaagcggcctctaggggtttctatcgtcttctctggctccgagtctggcacacggcctcctgacaatctcgtgggctcgagctgaggacgaggcggattacttacgtgttgctcgattagtcggtacgggttagtacggtacctaccgttttacggtacgttcggtttacccgttaacggtttcccggggaacggggtaaccgggggtaacccgtaaacggggtaccgttaccgggttaaccccgggtttacccggttcgggggtttaccccgaacgggtacccccgggtaaacgggtcccgttccccgggtcccccccggtttccggggtaccttaaccccggtttccccgttcccgggttttacccccccttaccccccgtttaccccgttacccgtttacccgggtttacccgttacctttcccgggttacggtaccggggtccccggggttccggg

SEQ ID NO: 61030 - DNA, 521 bp, Homo sapiens
  misc_feature: GYAE6OF02HIHIL.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgaggcactaagcggccctcaggggtttctatcgcttctctggctccgagtctggcaacacggcctccctgacaatctctgggctccaggctgaggacgaggcgattattactgttgctcattagtggcgggtagtacgctactttcgattgtcctagttcggcggagggaccagctgaccgtcgtgggtcacgccgaagcctcgcccctcgcactctctcccacctcctctacgtctactctgacgcggtcg

SEQ ID NO: 61031 - DNA, 388 bp, Homo sapiens
  misc_feature: GYAE6OF02FF2W4.12.53.E09.1.454.CMB.1.raw
  modified_base (375)..(388): a, c, t, g, unknown or other
  misc_feature (375)..(388): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtatagcactttcgatgtcctattcggcggaggaccaagctgaccgtctgggtcagcccaaggctgccccctggtcactctgttcccgccctcctctacgtcgtatctgagcggctggcaaggcgacatagnnnnnnnnnnnnnn

SEQ ID NO: 61032 - DNA, 539 bp, Homo sapiens
  misc_feature: GYAE6OF02G2NYQ.12.53.E09.1.454.CMB.1.raw
  modified_base (269)..(269): a, c, t, g, unknown or other
  misc_feature (269)..(269): n is a, c, g, or t
  modified_base (434)..(434): a, c, t, g, unknown or other
  misc_feature (434)..(434): n is a, c, g, or t
  modified_base (529)..(529): a, c, t, g, unknown or other
  misc_feature (529)..(529): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaatcatgatttangaggcactaagccggccctcgtaggggtttcttatcgtcttctctggcctccaagtctgactacacggcctccctgaccatctcgtgggcctccgaggctggacggacgaggtctaggtactttattatgactagctcattatacgaagcagcagtccacccttnttgtcgttaggaagttggaccaaggtcaccgttctacgtcacgcccaagcccaacccatcgtacactctccgtcccgccttctctccgtcttacnctgcgtccgg

SEQ ID NO: 61033 - DNA, 423 bp, Homo sapiens
  misc_feature: GYAE6OF02HZJUE.12.53.E09.1.454.CMB.1.raw
  modified_base (370)..(370): a, c, t, g, unknown or other
  misc_feature (370)..(370): n is a, c, g, or t
  modified_base (403)..(423): a, c, t, g, unknown or other
  misc_feature (403)..(423): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatggcgggtagtagctactttcgatgtctattcggcggagggaccaagctcgaccgtccgtgggtcacgacccgaaggctcggccccctcggtcaccttctcgtccccgccctcctcgtaccgttcgtatccnggtacggcggtcgtcggacgaggcgcagtacgnnnnnnnnnnnnnnnnnnnnn

SEQ ID NO: 61034 - DNA, 830 bp, Homo sapiens
  misc_feature: GYAE6OF02GC2PX.12.53.E09.1.454.CMB.1.raw
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
tcagatacgacgtacacgaccggtgctcgatttagagagagtgtgttgggtttgggggctttgcctgggctctgctgctcctcactctcctcactcaggacacagggtcctgggcccagtctcgcctgactcgacgtcgtcgtccgtcgtcgtcggtcggttcctcggtacgaacgtcgtacgtactaccaactactcctccgtcgaccgtacgggtaccggaccgacgacgtaggtagtaggttcgggttacggttaactttaaacctttaccgttccgttaccttaccgttaaccggaaacccaaacaaccccgaaccggacggaaaccaaccccgaaacccctaactactagtagttattacgagggaacgtacaacgtacggcccgtacccgtagggtttacggtttacttacgccgttcttccgttcggcggtccgtacggtactcggtacgaacctaacggcccgtcccttacganaactacgtcctacggtcgtcctaacggngtacggaggaacgtacggggacggacggtttaaatttacttacgtgttacgtactactaacgtaggtgggtacgggttagtactacgtttacgtagttacgtctttaccgttagggtaccgggacgggtacgaaccggtaagtccgtaccggtaccggttccgggttacgaccgtaaccgacccggaaacgttccggtacccgtccccggttacgttaccgaccgttttaccggtcccctttacccccgcccgtttacccgttaacccggttacggtttacccgttaccggttcggtacggggccggtacggtcccgggg

SEQ ID NO: 61035 - DNA, 542 bp, Homo sapiens
  misc_feature: GYAE6OF02FW7GC.12.53.E09.1.454.CMB.1.raw
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (496)..(496): a, c, t, g, unknown or other
  misc_feature (496)..(496): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactggaccagcagtgatgttgggacttataaccttgtctcctggtaccaacaacacccaggacaaacgcccccaaactcatgatttatgaggcactaagccgcctgtagggttctatcgtcttctctgctccgagtctgcaacgacgcctcctgacactctcgtggctcgagctgagcgaggcgtattactacgtgtgctacatagtggaggtagtagccttacttcgtattcgtctnttcgggnggacggacagcgtagccgtacgtggtcacgccaggcctccgcccgtcgtcaccgttctccgttaccccncccgttcctaccgttaccgtcgttactcgtggtacggcggtaccgg

SEQ ID NO: 61036 - DNA, 863 bp, Homo sapiens
  misc_feature: GYAE6OF02H06G7.12.53.E09.1.454.CMB.1.raw
  modified_base (134)..(134): a, c, t, g, unknown or other
  misc_feature (134)..(134): n is a, c, g, or t
tcagatacgacgtacacgaccggtgctcgatttagagagagtgtgttggggtttgggggctttgcctgggctctgctgctcctcactctcctcactcaggacacaggggtcctgggcccagtctgccctgactnagcctgcctcgtgtcgtggtctcctggacagtcgatcaccatctctgcacgtggaccagcagtgagtgttaccgggtacttaataccttgtactccgtacggtaaccaaacaaccaccaggacaaaccgaccccaaactcatagtaatttacgaggacgggaactaacgtaaacggcccggtacccgtacggttaacggggttttaccttaacgttccgtaccgttttccgtaccgttacggtccgttacccggtaacggtttaccgtacgggtaaccccgaaaaccggtaccccgggttaccccgttaccccgttaacggtaaacccttaaacgttcccgttaccgggttacggggtaccccttaaccgggaacgggtaccggtaaggaaacggggaacgggtaacgggtacgggttaacttttaacgttaacggttgttacgtactacgtaagttacggtagggtagggttaacgttaacgccgttacgtttactaacgttcgtaccgtttacggtaccggggaacgggtaaccggaaccgtaacggtaccgttcggaacccggtttccggtacggggtaaccgtaccgtaacccggtaaacggttacccgtacccggtacccccgttcggttaaccaacccgtttcccgttaacccggtaccccttacccttaccgttaccgttacgttaccgtacgttaccggtacggcgggtaacccggtcggg

SEQ ID NO: 61037 - DNA, 536 bp, Homo sapiens
  misc_feature: GYAE6OF02HT7SF.12.53.E09.1.454.CMB.1.raw
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactggaccagcagtgatgttgggacttataaccttgtctctggtaccaacaaccaccaggcaaacgacccccaaactcaatgactttatgagggcactaaagcggccctcgtaggggtttcttaatcgcttctctggctccgagtctggcaacncggccncctgacaatctctggctcagctgaggacgagcggtattatacgtgtgctcatngnggtagtantacttgatntctagtccggnggaggacagcncgaccgtcgtggcagcccgaaggccaccgccctcgtcacctcgttaccgtccccgtcccttccctacgttaccgtacgtacgtctcggcggcggtaccgg

SEQ ID NO: 61038 - DNA, 388 bp, Homo sapiens
  misc_feature: GYAE6OF02FGBHP.12.53.E09.1.454.CMB.1.raw
  modified_base (377)..(377): a, c, t, g, unknown or other
  misc_feature (377)..(377): n is a, c, g, or t
  modified_base (383)..(388): a, c, t, g, unknown or other
  misc_feature (383)..(388): n is a, c, g, or t
tcagatacgacgtacacgaccggtgctcgatttagagagagtgtgttgggacttataaccttgtctcctggtaccaacaacacccaggcaaagcccccaaactcatgatttttgatgtcactaatcggccctcaggggtttctgatcgcttctctggctccaagtctgactacacggcctccctgacaatctctgggctccaggctgaggacgaggcggattattactgtttgctcatatgcgggtagtagcacttttcgatgtcctattcggcggaggggaccaagctgaccgtcctgggtcagcccaaggctgccccctcggtcactctgttcccaccctcctctacgtcgtatctgagcggggctggcaaggcncatagnnnnnn

SEQ ID NO: 61039 - DNA, 386 bp, Homo sapiens
  misc_feature: GYAE6OF02IIJW5.12.53.E09.1.454.CMB.1.raw
  modified_base (377)..(386): a, c, t, g, unknown or other
  misc_feature (377)..(386): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaaagcggccctcaggggtttctgatcgcttctctggctccaaggctggcgaccgggcctccctgacaatatctgggctccaggctgaggacgaggctcattactactgctgctcatatggagttatagcacgttggggtgttcggcggcgggaccaaagtgaccgtcctaagtcagcccaaggctcgccccctcggtcactctcgttcccaccctcctctacgtcgtatctgagcggctggcgaaggcgcatagnnnnnnnnnn

SEQ ID NO: 61040 - DNA, 711 bp, Homo sapiens
  misc_feature: GYAE6OF02IZ6UB.12.53.E09.1.454.CMB.1.raw
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatggttggacttataaccttgtctcctagtaccaacaaccacccaggacaaacgccccaaancatgatttangaggcagtaagcgcctacgtagggttttactatcgtctttctcgtcggtacctccggagtccgtacggaccaaccgtaccggcccttacccgtagaacctaacttccgtccgttcgggtaccttaccgaggtacgttacggaacgggaccggtaagggccgtttaatttaacgttttaccgttggtttacgacttacgtagttagtcgggtacgggttaagtacgtaccttacgttcgattccgttaccgttagtcccgggaggaacggaccaagtccgtacggtcccgtcgtacgggtacaccgtaaccgtacggtccgtccccgtacccccgttaggtcccttaccgtcccggtttaccggttcccccgtaccctttcccggtttaccgtacccggtttaccgttacgttaccgtacggggtaccgggtcccggtacgg

SEQ ID NO: 61041 - DNA, 534 bp, Homo sapiens
  misc_feature: GYAE6OF02JDE4V.12.53.E09.1.454.CMB.1.raw
  modified_base (404)..(404): a, c, t, g, unknown or other
  misc_feature (404)..(404): n is a, c, g, or t
  modified_base (510)..(510): a, c, t, g, unknown or other
  misc_feature (510)..(510): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagccccaaaatcatgatttatgaggcactaagcggcctcaggggtttcttatcgcttctctggctccgagtctggcaacacggcctcctgacaatctctgggctccaggctgacggacgaggcggaatttatactgttgctcgatatgcggtagtancgtacttcgattgtcctagttcggcggtaggaccgaagctaggaccttccgtgggtcacgcccgaaaggctcgtcccctggtcacgtctcgttcccgcccgttccncgtacgtcgtatcgtgagcggtcg

SEQ ID NO: 61042 - DNA, 563 bp, Homo sapiens
  misc_feature: GYAE6OF02F6ZFG.12.53.E09.1.454.CMB.1.raw
  modified_base (268)..(268): a, c, t, g, unknown or other
  misc_feature (268)..(268): n is a, c, g, or t
  modified_base (371)..(371): a, c, t, g, unknown or other
  misc_feature (371)..(371): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttangagggcactaagcggccctcgagggtttcttatcgtcttctctggctccgagtctggcaacacggcctccgtgacaatctcgtggctcgaggctggaggacgnggcggtattatacgtgttgctcatgtggtcgggtagtacgctacgtttcgagttcgttaccttagttccgggcggacgggtaccgagtcgtcgtaccgtccgtggtcgacgacccgagccgtcgcccctcggtctaccgtctccgttcccctcccgtcctccgttaccgtcgttactcgtcgtcggcggtcg

SEQ ID NO: 61043 - DNA, 573 bp, Homo sapiens
  misc_feature: GYAE6OF02FPP1Y.12.53.E09.1.454.CMB.1.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (442)..(442): a, c, t, g, unknown or other
  misc_feature (442)..(442): n is a, c, g, or t
  modified_base (524)..(524): a, c, t, g, unknown or other
  misc_feature (524)..(524): n is a, c, g, or t
  modified_base (569)..(570): a, c, t, g, unknown or other
  misc_feature (569)..(570): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtcctcctggtaccaacaactaccccggacaaacgtccccaaagttaactactatttatgagggcacgtaagccggccctnaggtagtttcngactcgcttctcgtcggctaccgaaggtcgtgggccggacccgggtccctcccgtagaactaatactcgtcggcctccgaggctggacggacgaggctactattactactgctgctacatgtggtagttangcgtacgttgggtggtcggcgggacggaacctaaggtccgaccgttacctagcacgaccgtacggcctccgccccgtcgtcnctctcctccctacctctctcgtctatcgagcgcggctgacgacgnntag

SEQ ID NO: 61044 - DNA, 635 bp, Homo sapiens
  misc_feature: GYAE6OF02GHWMF.12.53.E09.1.454.CMB.1.raw
  modified_base (370)..(370): a, c, t, g, unknown or other
  misc_feature (370)..(370): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataacttgtctctggtaccaacaacaccaggacaaacgcccccaaactcatgatttatgaggcactaagcggccctcgtacggggtttcttatcgtcttctctggcctccgagtcgtggacaacgaccggccctccctgacaactctcgtggcctaccgnggtcgtaggagtacggacggacggtaattacttacgttgttcgtctcattagtgggtcggtaagtacgtctacgtttacgattcgtaccttacgttccgggacgggacggaccaagtcgtacgtacccgtcgtcgggtacacgtaccgaacggccgtaccgccccgtacggtcccaccgttccgttcccgttccccctaccccttcccgttacccgttaccggttccgttaaccgttccggtcggtaccgggtaccgggtccggg

SEQ ID NO: 61045 - DNA, 376 bp, Homo sapiens
  misc_feature: GYAE6OF02FF5N8.12.53.E09.1.454.CMB.1.raw
  modified_base (372)..(376): a, c, t, g, unknown or other
  misc_feature (372)..(376): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctggtcactctgttcccgccttcctctacgtcgtatctgagcgggctggcaaggcgcatagnnnnn

SEQ ID NO: 61046 - DNA, 580 bp, Homo sapiens
  misc_feature: GYAE6OF02GO8EC.12.53.E09.1.454.CMB.1.raw
  modified_base (270)..(270): a, c, t, g, unknown or other
  misc_feature (270)..(270): n is a, c, g, or t
  modified_base (575)..(575): a, c, t, g, unknown or other
  misc_feature (575)..(575): n is a, c, g, or t
tcagatacgacgtacacgaccggtgctcgattttagagagagtgtgttgggtttgggggtttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggacaaacgccccaaactcatgatttangaggcactaagcggccctgagggttttctatcgcttctcgtggctcgagtctggacaacgaccggtcctccctagacaattcctcgtcggctccgagcgtggaggacgaggcggtatttagttacgtgttgcttcattagtggtacggggtagtacgactacgtttcgattcgttacttgttcgggcgggacggacaacgctcggaccgttcgtcgggtcacgtcccgacggctccgccccgtcgtcctactccgtccttaccctacccgtccttcgtaccgttcgttactcgtaggtcggcggntcggg

SEQ ID NO: 61047 - DNA, 515 bp, Homo sapiens
  misc_feature: GYAE6OF02F53CB.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctgtaccaacaacaccaggcaaagcccccaaactcatgatttatgaggcactaagcggccctcgaggggtttcttatcgcttctctggctccgagtctggcaacacggcctcctgacatctcgtggctcaggctgaggacgaggcggattatacgtgctagtcatatacaagcacttccactctcgtgtcgtcggcgtcggacagctcgaccgtctagtcacgccaagctcgccctcggtcactcgttcgtccctcctcctctaccgtctactccgtgcggcggtcgtacgg

SEQ ID NO: 61048 - DNA, 568 bp, Homo sapiens
  misc_feature: GYAE6OF02HCNNE.12.53.E09.1.454.CMB.1.raw
  modified_base (269)..(269): a, c, t, g, unknown or other
  misc_feature (269)..(269): n is a, c, g, or t
  modified_base (402)..(402): a, c, t, g, unknown or other
  misc_feature (402)..(402): n is a, c, g, or t
  modified_base (469)..(469): a, c, t, g, unknown or other
  misc_feature (469)..(469): n is a, c, g, or t
  modified_base (488)..(488): a, c, t, g, unknown or other
  misc_feature (488)..(488): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtactctggtaccaacaacacccaggacaaacgccccaaactcatgatttangaggcactaagccgcctcgtagggtttctagtcgcttctcgtcggctccgagttctggaccaacaccggtcctcccgagacaatctcgtgggctcaggctaggaggacggaggacgtattatacgtgttgctntaattgtggtgggtagtagctacgttgagttgtcctagttcggacgaggaccagcgtacgccgtcgnggtcagacccgaacggtcnccgtccccgtcgtcctacgtcctaccgttacccctacccttcctacgttaccgttcgttactcgtcggacggtcggtacg

SEQ ID NO: 61049 - DNA, 707 bp, Homo sapiens
  misc_feature: GYAE6OF02HVSLW.12.53.E09.1.454.CMB.1.raw
  modified_base (131)..(131): a, c, t, g, unknown or other
  misc_feature (131)..(131): n is a, c, g, or t
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (525)..(525): a, c, t, g, unknown or other
  misc_feature (525)..(525): n is a, c, g, or t
  modified_base (554)..(554): a, c, t, g, unknown or other
  misc_feature (554)..(554): n is a, c, g, or t
tcagatacgacgtacacgaccggtgctcgatttagagagagtgtgttgggtttgggggctttgcctgggctctgctgctcctcactctcctcactcaggacacagggtcctgggccagtctgccctgactnagtcctgcctcgtgtcgtgggtctccgtggacagtcgatcaccatctcctgcacgtaggaaccngcaggtgacggttggtagttataactntcgtctctaggtaaccaagacgaccaacccgagggctaacgaccgacccctaaaagtcatacggttattttggaacttcgtacaacgtaagtccggtacccgttcggtagggttttctagtacgttcgtccttctcgtcgacctaccgtaatacgtacgaacctaacgaccggtcccttaccgaggtaactacgttcgttacggtacggaccctacggacgtcgtaaggaacggtaccggaggtacgttagtaactttaagtacgttacggactacggtccttaagaactaacgtaaacgaanaccgtaatacggacctaaccttaccgttnttttacggaccggttacgggtaaagggttacggaaacccgtaggtaccccgtccttaaccgtaacgtaccgaccggtaacccgtacgaacccctaccaacgtacgttctaactcgtccctaaccctcccttaccgtcctaagttctaagtcgg

SEQ ID NO: 61050 - DNA, 762 bp, Homo sapiens
  misc_feature: GYAE6OF02HF15F.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactggaaccagcagtgatgcgtgggagtgtagttaacgtttgtcctccgtacggtaaccaacactaccaaccgaggaccaaaccgcccccagacctacatagtaatttagtaggaacgggaaaccaaaaaccgggtccccgttacggggtaacttttacgtaacgttccggtacctttccgtcgtcgggtcctaaccgtaaggtccgtacggaacctaaccgaccggtccctcgtacgaactaactcgtacggtcggtctaccggaggtacgtagggacggacggtacggtactagttaatttacgtacgtcgtcttcggactacgtaatttgacgtacggtaggttacgttacgggtccttaacgtttcccgagttaaccgttacgggttaccggggacggggtaaaccggtacccgtaaggtcccgttaaccggttacccgttacccgggtaacttaacccgaccgggtacccgtacgccccgttcccgggtaacccccgtccgttacccgtacgtttccccgttccgttaaccccccgttcttacccgttaccgtaccgttttaccgagttcccggg

SEQ ID NO: 61051 - DNA, 396 bp, Homo sapiens
  misc_feature: GYAE6OF02GZ3DM.12.53.E09.1.454.CMB.1.raw
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (378)..(379): a, c, t, g, unknown or other
  misc_feature (378)..(379): n is a, c, g, or t
  modified_base (381)..(396): a, c, t, g, unknown or other
  misc_feature (381)..(396): n is a, c, g, or t
tcagatacgacgtacacgaccggtgctcgatttagagagagtgtgttgggacttataaccttgtctcctggtaccaacaacacccaggcaaagcccccaaactcatgatttatgaggggcactaagcggccctcaggggtttcttatcgcttctctggcctccgagtctggcaacacggcctccctgacaatctctgggctccaggctgaggacgaggcggatttattactgttgctcatatggcgggtatagctactttcgatgtcctattcggcgagggacaagctgaccgtccngggtcagcccaaggctcgccccctggccactctcgtcccaccctcctctacgtntatctgagcggcgtggcaggcnatagnngnnnnnnnnnnnnnnnn

SEQ ID NO: 61052 - DNA, 414 bp, Homo sapiens
  misc_feature: GYAE6OF02GYV3M.12.53.E09.1.454.CMB.1.raw
  modified_base (389)..(389): a, c, t, g, unknown or other
  misc_feature (389)..(389): n is a, c, g, or t
  modified_base (397)..(414): a, c, t, g, unknown or other
  misc_feature (397)..(414): n is a, c, g, or t
tcagatacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacaccggcctccctgacaatctctgggctccaggctgaggacgaggcggattattactgttgctcatatgcgggtagtagctactttcgatgtcctattcggcggagggaccaagctgacccgtcgtgggtcagcccaggctcgccccctcggtcactctcgttcccactctccctctacgttcgtactcgtgacggccgggctgggacaacggggcnctagtagnnnnnnnnnnnnnnnnnn

SEQ ID NO: 61053 - DNA, 704 bp, Homo sapiens
  misc_feature: GYAE6OF02F9TZE.12.53.E09.1.454.CMB.1.raw
tcagatacgacgtacacgaccggtgctcgatttagagagagtgtgttggggtttggggggctttgcctcgggctctgctcgctccttcactctcctcactcaggacacagggtcctgggcccagtctgccctgactcgagcctgcctccggttgtctgggtctcctggacagtcgatcaccatctcctgcacgtggggaccaggcgagtgtagtgttcgggtacttactaacttgtcctcctggtaccaacaacacccgaggacctaaacgccccctaaactcaattggaactttagtgacgggactacgtaacggccggcctcgtacggggtttctagtcgcttcgtcgtcggcttccggaagttacgtggaccaacgtacggtccctacccgtagacctaacgtctacgtcggacttaccgaggtctggacggacgaggacgtattacgtacgtgttacgacgtcgtagttgtggtacggtagtacgtactacgtttacgagttacgtacgttagtccggacgggtacggacgaacgtccgtacgtcccgtaccggtggtaccgtacgtaccggtaacggtcccgtaccggtcccccgtacggtacccgtaccgttccggttaccggttcccccgtttacccgtccgttaccgttaacccggttccggtacgttcccgggaccgggtacggcgggtaccggg

SEQ ID NO: 61054 - DNA, 743 bp, Homo sapiens
  misc_feature: GYAE6OF02HG1V9.12.53.E09.1.454.CMB.1.raw
  modified_base (271)..(271): a, c, t, g, unknown or other
  misc_feature (271)..(271): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcacgtcgggaccagcagtgatggttggacttataaccttgtctcctggtaccaacaacacccaggacaacgaccccaaatcatgatttanggacggcactaagccggcctacgtacgggtttcttacgtcgtactttcgtcgtcggtcctccggagtcttcgggacctaaccgtaccgggcccctcctaggaccaacgttccgtcggtacgggccttccgaacggtcgtacgggaacgggaaccggtaggacgggttattttacgtttacgttcgggtttcaccttacggtaattacggtacgggtacgggttagtacgggtaccttacgtttacggattccggtttacgttcgtttaccggggacgggtacggtaaccgtaacggtcgtacggtacccggtacggttcgggaccttaaccgggcccgtaaagggtcccttacccggtacccccggttccggtactaacccgttccggttacccggttacccccacccgtttacccgttacgttacccggttaccgttaccgttaccgtacgggtaccgtccgggttaccgg

SEQ ID NO: 61055 - DNA, 564 bp, Homo sapiens
  misc_feature: GYAE6OF02GQSL9.12.53.E09.1.454.CMB.1.raw
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaatcatgatttatgagggcactaagcggcctcgagggtttctatcgcttctctggctccgagtcnggcaacacggcctcccngacaatctctgggctccaggctggagacgaggcggtattacttactgttgctcatatgngggtagtagctacgttcgattgtccttagtccggnggacggacacggtactgacccgtctcgggtacacgcccgaaggcctccgtaccccctggtccgaccgttcgttccgtttccccacccttcccgtaccgttacgtcccgttaattcctagaccggcggtaccgg

SEQ ID NO: 61056 - DNA, 672 bp, Homo sapiens
  misc_feature: GYAE6OF02GOVHD.12.53.E09.1.454.CMB.1.raw
  modified_base (280)..(280): a, c, t, g, unknown or other
  misc_feature (280)..(280): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggccaanaacgcggccctgagggtttcttatccgcttctctggctccgagtctggccaacgaccgtcctccctgaacctaacgtccttcgtcgggccttaccgacggcttaggacgggacggagggcggtactttacttacgttggttcgaccgttactaagttactgggtacggggttaagtacggtaccttaaccgtttcggaatttcggttacctttacggtttcgggacgggtaacgggaccgtaagcctacgggacccgttccggtcggttaccaccgacccgtaacggtccgtccgacccccgttcggtaccaccgtttccctaccggttaccccctcccttccccgttaccttaccggttacgtaccgttcggtacgtacggtccggtacgg

SEQ ID NO: 61057 - DNA, 815 bp, Homo sapiens
  misc_feature: GYAE6OF02G4G7E.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtcgtgggtctccgtggacagtcgatcaccatcctcctgcacgtcggaccagctagtgattggttaggtacttaacttaaccgttgtcctaccgtacggtaaccaaaccaaccaacccgacggaaccaaaacccgacccccctaaaactctaagttacgtaatttagtaggacggacctaaacgtaacggcccggtcccgttacggttacggggttttactacgttccgtcgttccgtccgtcggtccgtacgtacgtccgtacggaaccaaccggtacccgtcccttacccgtacgaacctaaccgttccgtaccggtacggtacccgtaccggtaggtcgtacgggaacggggtaaccggtagggtaacggttaatttaaccgtttaggttcgttacgtaccgtactaaacgttacgggtacgggttacggttacggttactaccgttttaccgttacgtaccggttcgttaccgttaggtccggggaacgggtaaaccggtaacgacggttaccgtaccgggtacccggttcgtacgggtaccgaccgtaacccgggtacgtccccgttacccggtcccgttaccgtcttcccggttccgttaccccgtcccgtcccctttaccgtccgtaacgttccgttacgtccgtaacggccggtcggtacgg

SEQ ID NO: 61058 - DNA, 771 bp, Homo sapiens
  misc_feature: GYAE6OF02IJMNP.12.53.E09.1.454.CMB.1.raw
  modified_base (195)..(195): a, c, t, g, unknown or other
  misc_feature (195)..(195): n is a, c, g, or t
tcagatacgacgtacacgaccggtgctcgatttagagagagtgtgttgggtttgggggctttgcctgggctctgctgctcctcactctcctcactcaggacacagggtcctgggccccagtctgccctgactcagcctgcctccgtgtctgggtctccgtggacagtcgatccacatctcctgcacgtgggaccngcagtgatggtggtaacttagttaaccttgtcctccgtacgtaacccaacaaccgacccagacaaaccgccccaaatcagtgtacttagtgaggactaacaacgccgaccttacgacgggtttacttactcggtccttactcgtcggtcgtaccgtagtaccgtcggaacctaaccgtaccggtccctcccgtagaacctaacgtcccttcgcggtcctaccgaggtcctggaacggacgtaggacgtaacgtttaattccgtagtccgtactacgattacgtaggtacggttagacgtactttaaccgttcgtacgtttacggtcccgttaaggttaccgggtacggtaaccgggtaaacctaaacgggtaccgttaacccgggtttaacccggttcccgttaacggggtacggtaaacccggacccggttaaacccggttcccgtaccccgggttaccccgttccggtacccggttaacctccccgtttaccgttaccccctacccggttaccgtttacccggttacccttaacgggttccacgggttaacgtacccggggtaccgtaacgggg

SEQ ID NO: 61059 - DNA, 658 bp, Homo sapiens
  misc_feature: GYAE6OF02HXL6L.12.53.E09.1.454.CMB.1.raw
  modified_base (540)..(540): a, c, t, g, unknown or other
  misc_feature (540)..(540): n is a, c, g, or t
tcagatacgacgtacacgaccggtgctcgatttagagagagtgtgttgggtttggggctgggcctcaggaagcagcatcggaggtgcctcagccatggcatggatccctctcttcctcggcgtccttgcttactgcacaggttccgtggcctcgtatgacctgactcagcccaccctctgtcgtccgtactccccgaggacagacagtcaacaatctcatcgctctggagactgcgtaggttagggggtaaatttgtcgttttcgtggtatcgagcgaagaacgcgacgccaccgttcccttgttcgttcgtacagttacgttaagtaacggatacggacgacgggtccgaccgttcggaagggtactttcggagtaacgtcgttacgttccgccgcctaccaaccgtccggacaaccgacgaccgacctctcgtacaccgtataccggagggcccccgggacacgggtctacggtacgtaagtccggtacgacgttacgtaacctttagacccgtggaaccgacgggttcgacgggacnccgttaccctaccgttacccgtttccgtagtcggtcgggttacgacgggttaccgactcggtccgacgtcccgtacgtacggccaccgaacccaacgaccccgacctacgtctacccg

SEQ ID NO: 61060 - DNA, 803 bp, Homo sapiens
  misc_feature: GYAE6OF02HP8MP.12.53.E09.1.454.CMB.1.raw
tcagatacgacgtacacgaccggtgctcgatttagagagagtgtgttgggttgggggctttgcctgggctctgctgctcctcactctcctcactcaggacacagggtcctgggcccagtctgccctgactcagcctgcctccgtgtctgggtctcctggacagtcgatcaccatctcctgcactcgggaccagcagtgatggtaggacttaatacttgtctcgtgtacaacacaccagcaacgaccccaatcatgattatgaggcacgtagccgcctacgtaggggtttaccttagtctcgttactctggtcctaccgagtcttcgggaccaaaccgtaccggtcccttacccgtaagtaccgtaaactccgtccgttcgggaccttcccgacggtctacgggaacgggaccggtaacgggaccggtagttttaacgtttaccgtttaggtttacggacctttaccgtaaacgtttaggtaccgtacggtaacgggaccgtacggtaaccctttaacggtttacggtttttaccgtttacccgggtaacggttacccgggtaacccgggtaacgttcccggtaacccgttaccggttaaccggtacggtaccgtaaccccgtaaccggaccccgttaaaccccgtacgttaacccgtacgttacccttcccggtttacccgtttacccccggtaaacccccttcccgtttacccgttaaaccggttacccggttaacgttacccggttaccgggtacggttaccccggggttaccggttaccgggttaccggtaaacccgggg

SEQ ID NO: 61061 - DNA, 878 bp, Homo sapiens
  misc_feature: GYAE6OF02FUCXB.12.53.E09.1.454.CMB.1.raw
tcagatacgacgtacacgaccggtgctcgattagagagagtgtgttgggtttggggctttgcctggctctgctgctcctcactctcctcactcaggacacagggtcctgggcccagtctgccctgacctcacgcctgcctccgtgtctgggtctcctggacagtcgatccaccatcctcctgcaactgggaccagcagtgactggttaggacttacgtacccttcgtcctccgtacggtacccaccaccgacccgaggtcccaaccgaccccctaaacgttcactagtacgtttacgtcggacgggaccaaccgtaaccggcccggtacccccgtcggttacgttttaccttactccgtcttctcgtcggcctcccggagttccgtcggaaccgtaacccgaccccgggtaccccctacccgtacggtaaccctaaccgttccttccgggtcgggtccctacccggacgggtcctacgggaacggaccggacgggtccggttaactttacgttacctggttacctcctacgtacgtacgtcgggtaccgggttaacgtaccgtacccgttaaccttacggtacgtttaccgttacccggtttaacggttaccccggggtaacgggtacccgggtaaacccgtaacggtccccgtttaaccgggtaaccccgtttaacccggttaaccgttaacccgggtaacccggtaacccccgtaaaccgggtccccttacccccggtaccccccggttccggttaccccgtacccggtttaccccgtttccccggttaacccccccgttacccgttaccccgttacccggttaccggttaccgtaccgttcccggtaccggtacccgggtcccggggttacccgg

SEQ ID NO: 61062 - DNA, 669 bp, Homo sapiens
  misc_feature: GYAE6OF02GI6E3.12.53.E09.1.454.CMB.1.raw
  modified_base (280)..(280): a, c, t, g, unknown or other
  misc_feature (280)..(280): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttggtaaattttgaccttagtctcctggtaaccaacaacgtaccccggacaaacgtccccaagttaactctatttangaggcactaagccggcctacgaggtatttctgtactcgtctttctcgtggcctaccgaaggccgtcggccggacccggggcctcccgtagacctaatacgtcgtcgggtcctaccgagggctggaacgggacggacggtctactaactttaccgtactcgccttagccttacgagttagtagggtaaggtttacacggtcgtacggttgggttcggttcgggccggggaacgggtaaccgtaaggtcgacccgtaccgtaacggtccgacggacccgaggtccgtccgcccccgttacggtcctaccgttcgttccgtccccgtcctcccgtccgttacgttccgttacgtcgttcggacggtcggtcggtacggccgacggcacgtag

SEQ ID NO: 61063 - DNA, 873 bp, Homo sapiens
  misc_feature: GYAE6OF02H2ZF1.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatcctcctgcacgtggggaccagcgagtgtagtggttagggtaactttaactaacctttgtaccttccgtacgggtaacccaaaccaaccaacccgaacgggaccaaaacccggacccccctaaaactccaagttggtaactttttagacgggaacggggtaccaaacggtaaacgggtccccgggtacccccgttacgggttacggggggtttttactttacgttccggttccttttcgttcggtcggtcccttaccggtacgttccgtcgggaccctaaccgtacccgggtccccttacccggtagaacctaacgttcccgtcggttccgggaccttccggaagggtcgtacggtacgggtaacggtacggggtaccgggttaatttaaccgtttacgtttgggttaccgtacggttactaagttaacggtcggggtaacgggttacgacgttaccttaccgttttaggacgtttcgtttaccgttaggttccggggacgggtaacggccgtaaagtccggttccggtaacccggttccgggtacgggtcccgtaccggacccggtaacggtcccgtacccggtcccccgttagggtcccttacccgttcccgtttccccggtacccccttcccgttaaccgttcccggttaaccgttccggttaacttcccgggtggtacgggtcccggtaaccggg

SEQ ID NO: 61064 - DNA, 728 bp, Homo sapiens
  misc_feature: GYAE6OF02H4LD9.12.53.E09.1.454.CMB.1.raw
  modified_base (191)..(191): a, c, t, g, unknown or other
  misc_feature (191)..(191): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (429)..(429): a, c, t, g, unknown or other
  misc_feature (429)..(429): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctctgcacgtggaccngtcagtgatggttggacttatacttgtctctgtacaacacnccaggacaacgcccaancatgatttagngtaggcactaacgcgtcctagtcgggttctacgtcgcttctntcggctcgactcgtgacacgcgtcctccgnaactactcgtacgtggtacctccgtaaggcgtacggtaacgggaccggtaacgggtacgggttaaatttacggtttaacttcggttttcgacccttntaacgttaacggttcgggtaacgggttaaacgttcggtaaccgttacgttttacgaacggtttccgttaccgttaacggtttaccggggacgggtacggtaaaccaccgggttccgtaaccggttacccggttacgggtcgggttaaccaccggggttaaccccgtaacggttcccggtacccgtacccccggttacgttaccgtacccgttcggttttaccccgtaaccccgtcccgtaccgttaccgtttacccgttccggttaactcccgggtaacgtccgggaccggttacccgg

SEQ ID NO: 61065 - DNA, 951 bp, Homo sapiens
  misc_feature: GYAE6OF02IYZCB.12.53.E09.1.454.CMB.1.raw
  modified_base (370)..(370): a, c, t, g, unknown or other
  misc_feature (370)..(370): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgtatccaccatcctcctgcacgtgggaccagcagtgatcggttgggacttaataaccgttgtccttccgttcggtaaccctaaaccaacctaccccgaaggacccaaaacgacccccaaaacctcgattacgtaatttataggacgggtacaactaacggccggtccctcggtacggggttttactacttccggtcgttttccncgttacgggcctaccggtacgttccgtcggtaaccaaccgacccggtccctcccgttaacggaaccttaaccgttcccttcgggttccgggacccttaacccgagggtacccgtagggaaaccggtaaccgggagggtacccgggtttaaattttaaccgtttaacgttacggtttggtaccccttagtaagttaccgttagtaccggtttaacggggttacgtaaaccggtttacccgttaaccgtttttacggaacgtttttccgggttaaaccccgtttagggtttacccggggtaacccgggggtaaccgggggtaaaccccgtaccggtaccccggtttacgggtaaacccccgggttttcccggttaccgggggtaacgtacccgggaccggtaaaccccggggttcgttacccccggtccccccggttaacccggtttacccggtaaccgtttttcccccggtttaccccgggggtttacccccccctacccccgtttaccccgttttacccggttaacccggttttacccggttacccgttacgggttaccgggtaccgggtacccccggggg

SEQ ID NO: 61066 - DNA, 726 bp, Homo sapiens
  misc_feature: GYAE6OF02IMM33.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctccgtggacagtcgatcaccatctcctgcacgtggaccagcagtgatggttggacttataccttgtcctcgtggtaaccaacaaccaccaggacaaaccgacccccaaactactactagtatttaacgtaggtacggactaaccgtaaagccggtaccctcggttacgggttttcttagtcgtccttctcgtcgacctccgagtctcggacaaccgacgtccctcctacgacaactcctcgacgtcgtaccgacggtcgtaggacgggaacggagggtacggttagtttaacgtttacgttcgttcgtctactagttacggttgggtacgggttaacgtacggtacctttacgttgttacgtttacgtttaccgttaggttaccgggtacgggtaacgggaccgtaacggtccgtacgttacccggtacgtacgggtaccgtacgacccggtaacggtccgtacccgtccccgtacggttacttacccgttcccgttacccgtaccccgttccccttaccgttcccgttaccggttacctccggttacgtacgggtaccggcggtacccggg

SEQ ID NO: 61067 - DNA, 717 bp, Homo sapiens
  misc_feature: GYAE6OF02GKH60.12.53.E09.1.454.CMB.1.raw
  modified_base (264)..(264): a, c, t, g, unknown or other
  misc_feature (264)..(264): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgtggactataccttgtctctggtaccaacaaccaccaggacaaacgccccaaatcatgatttangaggcactagcgccctgtacgggtttctagtcgtcttctcgtggtcctccggagtcgtggacctaacgaccgtcccctccgtagaactacttctcgtcggtcctccgacggctaggacggacggacggtcggtaatttacttacgtggttctacgtactattacggtggaccgggttagtacgcttaacgtttcgacgttcgtaccgttcggttaccgggacggaacgggtacctaacggtaccgtaccggtacccgttccgggttacgggtaccgtaaccggtacccggtaaacggtcccgttaacccccgtcccccggttacggttaccctacccggttcccgtttaaccccggtttaccccccttaccccggttacccgtttaccccggttaacccggtttacccgttacgtttcccggtacggttaccccggggtccgggttaccccgg

SEQ ID NO: 61068 - DNA, 885 bp, Homo sapiens
  misc_feature: GYAE6OF02FT6HL.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctaccgtgtctgggtctcctggacagtcgatcaccatctcctgcactgggaccagcagtgatcgttgggacttataaccttgtctccgtaggtaaccaacgaacaccgaggactaaacgcccccaaactccaagtagtatttacgtgagggaccaacgtaacgccggtacccttaccggtaggggtttaccttaagtccgtctttaccgtcgttacggccgtacccggtaaggttccgtacgggactaaaacccggtaccgggtccccttacccgtaggaacctaacgtacccgtcgttacggggcctacccgtaagggtcctagggaacgggaacgaacggggtcccggtaaattttaacgttaaccgttggtttacgtaccgttacgtaacgttaacgttacgggtaccggggtttaaagtaaccgtacgtttaacccggtttacgtaacgtttaccgttaccggtttaacggttccgggtaacccggggtaaacggtaacccggtaaacggtaaccggttaccggtaacccgggtaccggtttaccggggtacccgtaaccggtaaacccccggtaaacggggtcccgttaacccgggtacccccccggtttaggtaaccccgtttacccggttaacccgtttacccgtttaaaccccccgtaccccgtttacccgtttaacccggtttaaccgttaacccgttaacgtttaccggtacgggtacgggtcccgggttaaccgg

SEQ ID NO: 61069 - DNA, 1004 bp, Homo sapiens
  misc_feature: GYAE6OF02JF59G.12.53.E09.1.454.CMB.1.raw
tcagatacgacgtacacgaccggtgctcgatttagagagagtgtgttgggtttgggggctttgcctgggctctgctgctcctcactctcctcactcaggacacagggtcctgggcccactctgccctgactcagcctgcctccgtgtctgggtctcctggacaggtcgatcaccatcctcctgcactgaccaaccagcagtcgaacgtttaaatgaattaaactaaacttacttttcctcccgttacggtaaccacgaccaaaccaaccccgagggaaccaaaacccgaccccccaaaaccttacccttacctaattttagtacgggttcgggtaccggggtaaacgttccgggtcccccgttaccggtacggggggtttttacctaaacggttccggtccttttccgttccgttcggggcccttacccgtaaacggttccgttacggggtaaccgaaaaacccgggtcccccttacccccgtacggtaaccctacgttaccttcgttaccgggacccttaccctaaccggtcccggttacgggaacgggtaaccgggtaacgggtacccggtaaccgttttaaaccttaccggtttacggtaaccttaacggttttacgtaacccgaacggaaaccgggtaaaaccgtaaacgggggttaaccgttaaccccggtttaaacgggtttacggggggttttccgggttttacccggggggtaacgggggaacccggggtaaaaccccggttaaacccggtacgggttaaacccccgggttcccggttaacgggttaccgaacccggtacccggaaacccgggtccgttaacccccggtcccccgttaccggggttacccttacccggttaccgtttcccccggttaccccccttaacccccgttaccccttcccgggtttaaacccgtttccggtttaaccgttcccggttacggtaccggggcccggttaccgggtaccgggtaccggaccggtaccgtaacgg

SEQ ID NO: 61070 - DNA, 780 bp, Homo sapiens
  misc_feature: GYAE6OF02F7ZH5.12.53.E09.1.454.CMB.1.raw
  modified_base (463)..(463): a, c, t, g, unknown or other
  misc_feature (463)..(463): n is a, c, g, or t
  modified_base (484)..(484): a, c, t, g, unknown or other
  misc_feature (484)..(484): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcacgcctcgcctccgtgtcgtgggtctccgtggacagtcgatcaccatcctcctgtcacgtgggaccagcagtgagttggttagggtacttaacttaaccgttcgtccttacccgtacggtaaccctaaaccgtaaccgaacccgaacggaaccaaaaccgacccccaaactaccgtattacgtaatttagaggtaacgggactaacgtaacggccgtcccgtacggttacggggttttaccttacgtccgttccttcgtccgttcgccgtaccgtacgttcgtcgaccaaccgaccggtccctacgtacgactaactccgtacgtcggccnccgagtcggtggacggacggnggtacgtactttagttcgtgtcgactagtaagtgtgggtacggtacttacggtacttcggttactacgtttcggttacgttacgggtcggggtaacggaacgggtaccgacgttccgggtacccggttaccggttcggtaccgggtaaccgcccgtaacccgtccggtaccgtccccgggtaccccgtacgtttacccgtcggtcccctttaccccggtaccccttacccccgtaccgtttacccgttacgtaccctaccgggttaccgggacgggtcccgggtacgtacccgggg

SEQ ID NO: 61071 - DNA, 839 bp, Homo sapiens
  misc_feature: GYAE6OF02I1RXE.12.53.E09.1.454.CMB.1.raw
  modified_base (271)..(271): a, c, t, g, unknown or other
  misc_feature (271)..(271): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatggttaggactttataaccttgtctccgtacgtaaccaacaaccacccgaggaccaaacgccccaaatcatntatttatggaagggaacaaaaaccggtcccgtaggggtactttactaacttcggtcctttcctcgttcggtcctaccgtaacgttccgtcggaccaaccgacccggtcccttcccgtagtaacctaaacttcccgtacggtcgggtacctaccggtaacgggtccgtaagggaccgggtaacggtaacggtcgttaacgtaacgttttaacgttttaccgtttagtttaccggtaccgttaaccttagttaacgggttcggggtaccggggtttaagtaaccgttaccgttacgtttacggtaacgtttccgtttaaccgtttacggttccggggggaaccgggtaaaccgggtaacccggtaacggtaccggtaacggttaccccggtttcggtaccggggtacccgaccggtaacccgtaaccggtccccggttacccggtcccccgttaacggtcccgttaacccgttcccgtttcccggttacccccccgttccgttaacccttcccggtttaaccgttccggttacctcgggttaccggacgggttccggaccggtaaccggg

SEQ ID NO: 61072 - DNA, 715 bp, Homo sapiens
  misc_feature: GYAE6OF02HFIQT.12.53.E09.1.454.CMB.1.raw
  modified_base (368)..(368): a, c, t, g, unknown or other
  misc_feature (368)..(368): n is a, c, g, or t
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
tcagatacgacgtacacgaccggtgctcgatttagagagagtgtgttgggtttgggggctttgcctgggctctgctgctcctcactctcctcactcaggacacagggtccgtggcccagtctcgccctgactcacgcctgccctccgtgtcgtcgggtctccgtggactacgtcgactacaccatcctcctggccacggtcggaaccagctaggtgagttggtacgggtacttaactaccttgtcctcgtcgtaacaactaacaccgacggacaacccgacccaaactcatatattagtaggacggactaacgacggtcccgtaccgtacgtacgggtttaccttgtccgtccttctacgtccggtcncgtacgtcgtacggaccaacgtccgtccctacgactacactcgtgacgcctacgaagcgtagacgggacgaggtacgttagttactgtacggtntaccgtntaagtcggtggtacggtagtcgtacttacgttacgcgttactccggttaggtaccgggaaccgggacgtacctacggtccgttaccggggtactttccggggaggtaccctacgggaacccgtaacggtccccgttacccggcccgtaccggttcctacccggtttccttccccgttaccccgttccgttaccgtacggttttacccggtacttaccggttcggaccggtcgggacccggttacgg

SEQ ID NO: 61073 - DNA, 767 bp, Homo sapiens
  misc_feature: GYAE6OF02JZWN3.12.53.E09.1.454.CMB.1.raw
  modified_base (340)..(340): a, c, t, g, unknown or other
  misc_feature (340)..(340): n is a, c, g, or t
  modified_base (758)..(758): a, c, t, g, unknown or other
  misc_feature (758)..(758): n is a, c, g, or t
tcagatacgacgtacacgaccggtgctcgatttagagagagtgtgttgggtttgggggctttgcctgggctctgctgctcctcactctcctcactcgaggacacacgggtcctgggcccagtctgccctgactcagcctgccctccgtgtcgtgggtcctccgtggacaggtcgatccgaccgtcctcctgctacgtcggacctagtaatcgtattttaggtaatttcggaactgtcctcctcggtaccaacaacgtaccccgactaacgtaaccccaatcagtgtattagtagacggcaacgtagccgacctcggttagggttctagaccgtcttcgtncggtcctcgactcgacgacctacggacccgtcctaccgtgaaacctactccgtcggtcggacctacggcgtggacggtaggaccgttcgggaacgttaattacgttcggttagtaccgtcttaacagtacgttcggtaacggtcggtaacgtacgttacttacggtacgttcgttaccgtaacggttaccgggacgggtaacggttacccgaagttacctaccggtacccggttaccggtaccggttaccgtaaccggtaaccccgacgttaccccggtaccccgttacccccggtaccgttaccgttaacccgttcccgtttaccccggttcccccgttaccccgtttccgtaacccgtttaccggttaaccgtaccgttcgtacggtcggtcccgggtaaccgtcgggtaacccgnggtaacccg

SEQ ID NO: 61074 - DNA, 833 bp, Homo sapiens
  misc_feature: GYAE6OF02I6097.12.53.E09.1.454.CMB.1.raw
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactaccccggcaaacgtccccaagttaatctatttatgagggcactaagccggacccctnaggtagtttcngatcgtcttctacgtcggtctaccgaaggcgtcgggccggacccggggccccttaccccgtagaacctaagttcttaccggtacggggtcccgttacccgaacgggtccgttacgggaacggggaccggtacggggtacccttacgtaacgttttaaccctacggttacgtcgtttaccggacttaccgtaagttaacgggttacggggttaaggttttaaacggttaacggtaccggttacgggtttcgggggtttacgggtttacccgggggaccggggttaacccgggaaacccggttaaaggttccggtaaccccggtttaccgtaaaccgggttccggaaacccggaccccgggtaaacgggttcccttaccccgggtcccccgtttacccggggttaacctccctttcccggttacccgttccccccgtaccccttccgtttacccgttaccgtttccgtacgttccggttacggaccgggtccgggtacgtccgggaccggtacggaccgtacgtacgg

SEQ ID NO: 61075 - DNA, 598 bp, Homo sapiens
  misc_feature: GYAE6OF02ID4JD.12.53.E09.1.454.CMB.1.raw
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (594)..(594): a, c, t, g, unknown or other
  misc_feature (594)..(594): n is a, c, g, or t
tcagatacgacgtacacgaccggtgctcgatttagagagagtgtgttgggacttataaccttgtctcctggtaccaacaacacccaggcaaagcccccaaatcatgatttatgagggcactaagcggccctcaggggtttcttatcgcttctctggctccgagtctggcaacacggcctccctgacaatctctgggctccaggctgaggacgtaggcggattattactgttgctcatatggcgggtatagctactttcgattgtccttagttcgggcggacgggaccaaggtctcggaccgttcgtgggtaccacggacccaaggtcctcccgtacccccgttcgggtactaccttccgtaccgttccccctacccttccgtcgttaaccggttcttacgtcgtacggtacggccgggtcctgggaccgaacggtccgtacgtaagtcggctgacagntcncgtancgngtanctcgtgcgncncgcgtcncgtcgtcgcgcgcgtctcgtcgtctcncgacgtcnctcncgcacgtacgtactacgtcgtagtacgtacgtcgacgtactgtcgtcgtcgtcgtacgtacgtntacg

SEQ ID NO: 61076 - DNA, 703 bp, Homo sapiens
  misc_feature: GYAE6OF02IKXMU.12.53.E09.1.454.CMB.1.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcacgtgggaccagcagtgattggttgggacttataaccttgtctcctgtaccaacacacccagacaaacgccccaaancatgtattangaggcacgtaagccggcctgtagggttttctacgtcgcttctcgtcgcgtccgagtctagacaacgaccggcccttccgtgactaacttcgtcgtcggggacctccgacggcgttacgggaacgggaccggtaggggtacggttaaagtttacgttttactggggtttctccgtaactaagttaccggtggtcgggttaagtacggtccctaacggttttcaacgtttcgtacccttaagggttccggtcggggtaacggacctaaggccgttaccggtacccggtccggtacgggtacgaccgtcccgaaggtccccgtcccgtacccccggtgttcccgaccgttcccgttcccggtcccccggttacccttcccgttccggttaacccgttcggttacctacgggtcgggtaccggtcccgggttaacggg

SEQ ID NO: 61077 - DNA, 576 bp, Homo sapiens
  misc_feature: GYAE6OF02IQEXK.12.53.E09.1.454.CMB.1.raw
  modified_base (113)..(113): a, c, t, g, unknown or other
  misc_feature (113)..(113): n is a, c, g, or t
  modified_base (223)..(223): a, c, t, g, unknown or other
  misc_feature (223)..(223): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (500)..(500): a, c, t, g, unknown or other
  misc_feature (500)..(500): n is a, c, g, or t
tcagatacgacgtacacgaccggtgctcgatttagagagagtgtgttgggacttataaccttgtctcctggtaccaacaacacccaggcaaagcccccaaactcatgatttangagggcactaagcggccctcaggggtttcttatcgcttctctggctccgagtctggcaacacggcctcctgacatctctggctcaggctgaggacgaggcgattattacngttgctcatattcggcgggtatagcctaactttgatctcctattcggcggtagggccaaagctggaccgtacctgggtccagcccgtaagggcctacgcccccttggtctacgtccgtttccccgccctaccgttctaacggtctacgcgttgacgtcgggctggacgacgggctacggtataacggtcgnacgtgcgntacgnatncagtnccaagngtacgtacgcgagtcgacgancgngacgagngcgactcgacgtacgagcgtcgcgtcgngcgacgtacgtacgtcgtcgtacgtactacgtacgtaccgacggacgtacgtacgtacgtacgttacgtacgtacg

SEQ ID NO: 61078 - DNA, 643 bp, Homo sapiens
  misc_feature: GYAE6OF02GDXGP.12.53.E09.1.454.CMB.1.raw
  modified_base (272)..(272): a, c, t, g, unknown or other
  misc_feature (272)..(272): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatcctcctgcactgggaccagcagtgatgttgggacttataccttgtctccgtgtaaccaacaacacccaggaccaaacgcccccaaactcatgattangaggcacaagccgcctcgtagggttcttatcgcttctctgctccgtagtctgacacgacgtcctcctagacaatctcgtcggctccgaggtctggaggacgcggacgtaatttactacgtgttgtctcattagtggtacgggttagtacgtcgtacttacgtattacgttacgttacgttccgggacgggtacggtaccgaaggtcgtacgtacgtccgtacggtcgaccgaccgaaacggtcctacccggtcccccttcggtcccgtaccgttcccggtttcccggtacccccgttcccccttacccgtttaccggttacccggtttaccgtttacgtcccggtacggtaccgggtcccgggttaacggg

SEQ ID NO: 61079 - DNA, 1194 bp, Homo sapiens
  misc_feature: GYAE6OF02GVRWW.12.53.E09.1.454.CMB.1.raw
tcagatacgacgtacacgaccggtgctcgatttagagagagtgtgttgggtttgggggcttttgcctgggctctgctgctcctcactctcctcactcaggacacgaggggtccgtgggcccagttcctcgccctgactcacgcctcgccctccgtgtccgttcggggtcttccgtggacacggttacgacttccaacctacttccttcccgtagaccgtaccggtcggggtaacccacgtcgtaaggtaggttaggtttgggtttacgggttaaacctttttaaacgttaaccgttttccgttacccgttacccggtttaaccgtaaaccccaaaaacctaaacccggaaaccccgaacggaaaccctaaaacccccggaaccccctaaaactacgttacttaacgtttaaagtttaggtaacgggtaacgggtaaccgtaaaccggttaaaccgggtcccccggttacccggtttaacggggtttttaccggggtttttacctttaccggtttcccgttccctttaccggttccggtcggttcccgtaccggtacggttccggtaccggacccgaccgtaccgggtcccccttaaccgtccgtaaacgtcccgttccggttcggttccgggtacccggtacggtacggtacgggtaaggggacggggtaccggtaacgggttaacggtttacgttttaacgggtttccgttacggttcgtaccgttaccggtaaacggtttacgggttaccggggttaacgggtttaccggtaaccggttaccgttttaaccgtttacggttacggtttaacccggttttcccggttaccggggttaccgggggtaaccgggtaacccggggtaacccgggtaccgggttacccgggttaaccccgggttacccgggttttaccggggtcccggggtttaacccgggtaacccccggggtacccgggtttaaccccggttacccccggttaccccccgggttttcccccgggtttacccccgttaccggttttaccccccggttttacccggtttaacccccccccgtttacccccggtttacccccggtttttaccccccgggttttaacccggttttaccccggttttaccccggtttaaccgtttttaacccggggggaccgggtttaccccggggggtacccggggtttaacccggggg

SEQ ID NO: 61080 - DNA, 457 bp, Homo sapiens
  misc_feature: GYAE6OF02GW2OU.12.53.E09.1.454.CMB.1.raw
  modified_base (275)..(275): a, c, t, g, unknown or other
  misc_feature (275)..(275): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (420)..(457): a, c, t, g, unknown or other
  misc_feature (420)..(457): n is a, c, g, or t
tcagatacgacgtacacgaccggtgctcgattttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctggagacgaggcggtattattactgttgctcatatgcgggttagtagctactttcgatgtcctatcggnggaggacaagctgaccgtctgggtcacgcccaaggctccgcccccgtcggtccacctctccgttaccccaccccttcctcttaccgtcgttactctggacggccgggtctcgggacgaaggccgacgaagttagcancngancgnnnnnnnnnnnnnnnnnnnnnnnnnnnnnnnnnnnnnn

SEQ ID NO: 61081 - DNA, 742 bp, Homo sapiens
  misc_feature: GYAE6OF02G0MFJ.12.53.E09.1.454.CMB.1.raw
  modified_base (435)..(435): a, c, t, g, unknown or other
  misc_feature (435)..(435): n is a, c, g, or t
  modified_base (556)..(556): a, c, t, g, unknown or other
  misc_feature (556)..(556): n is a, c, g, or t
tcagatacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtcgtgggtcctccgtggacagtcgatcgaccatcctccgtgcacgtcgggaccagcaggtgagtggttggacttactaaccttgtctcgtcgtaccaacacacccgagaccaacgacccccaaactcacgtgtatttagtaggacggacaacgtaacgaccggtccgtacggttacggggtttactttacgtcgtcttaccgtcgtcggtcgtaccgtacgtcgtacggccaaacgacccggtccctaccccgtgaacctaacgttccctacgtcgggtacctaccggngtacgtggaacggaggtacgggtacgtaatttacttagttaggtctacgtagtgtaacggtgggtacggttaggtaacgtccgttagttacgtagtttacgtaccgtttaggtacccgggnggggtaaccgtaccggaacgtccggtaaccggttaccccggtggtaccggggtaaccgtccggtaaccgacggtcccgtcccgggtacccttccgggtaccctccgttaacccgtcccgttaccccgtcccttaccgtaccgttaccgttacggttaccctggtaccggtacggtaccggtacggg

SEQ ID NO: 61082 - DNA, 753 bp, Homo sapiens
  misc_feature: GYAE6OF02J1HRM.12.53.E09.1.454.CMB.1.raw
tcagatacgacgtacacgaccggtgctcgatttagagagagtgtgttgggtttgggggctttgcctggctctgctgctcctcactctcctcactcaggacaccagggtcctgggcccagtcctgccctgactcagcctgcctccgtgtctgggtctcctggacagtcgatccaccactctcctcgcacgtggaccagcgtagtgattggttggaacttataaccttgtccttctacggtaaccaacctaaccacccgaggtaaccaaaccgaccccctaaactacctagtacgtagtttagtcggaggtacctaacgtaacggtcccgacccttcggtacgggtttctaacgtcgtcttctcgtacggccgtaccgagtacctcggacacgacccggtccctaccgataacgtacgtctccgtcgggacctccggagtcgtacggaacgggtagtcggtacgttattaaaccgtttgtaccgttagtactacggtacttagggtacggttaccggtagtacggttacccgttagttacggtacgttaccgttacgttacgggttaccgggacggtaaccggtaaccgttacggacggttccgtaacccgggttgggtcccgtacgtacccggtaaaccgtccggtaccgttaccccgtcccgccggttacgtacccgtccgttcccggttaccccctcggttcccgtaccgttaccggttcgtacttcggtaacggtcccggttccgtccggg

SEQ ID NO: 61083 - DNA, 751 bp, Homo sapiens
  misc_feature: GYAE6OF02IH6EC.12.53.E09.1.454.CMB.1.raw
  modified_base (647)..(647): a, c, t, g, unknown or other
  misc_feature (647)..(647): n is a, c, g, or t
  modified_base (692)..(692): a, c, t, g, unknown or other
  misc_feature (692)..(692): n is a, c, g, or t
tcagatacgacgtacacgaccggtgctcgatttagagagagtgtgttgggtttggggctttgcctgggctctgctgctcctcactctcctcactcaggacacagggtcctgggcccagtctcgccctgactcacgcctcgacctccgtgtcgtcgggtctcctggactagtcaactccaactactcctctagccaacggtcgggaccacgactaggtcgtagttacggttacggtaactttaaacgtaaccgtttcgtacccttccggtaaccgtaaaccaaaaccaaccgtacccggaacgtaaaccgaaaccccgtaaccccctaaataactaacgttaagttaacgtttaacgcgggacgggaactaacggtacgtccggtacctaggtacggttagtttcgtaacgtacgtcttcgttcgtcgtacgtccaacggtacgtcgccgggtaccgacccggtaccgtaccgtaacgacgtaacttcgtcggtaccgtccgtacgcggtacggacggacggtacgtaccggtactaacggtacttaacgtcgtacgcgtctaacgctaagttacgtaggtacgtagtacgtacggtttacgttcggtcggttcgggtacgacggtaccggaagtccgaacgtaacgngtacgccgtaaccggtctcgtcccgaccgttcgacctacgttccnccgtacccgtctaccgtacgtccgttacggactcggtaggtaccgtcggtactaacggg

SEQ ID NO: 61084 - DNA, 754 bp, Homo sapiens
  misc_feature: GYAE6OF02GQPDP.12.53.E09.1.454.CMB.1.raw
  modified_base (116)..(116): a, c, t, g, unknown or other
  misc_feature (116)..(116): n is a, c, g, or t
  modified_base (565)..(565): a, c, t, g, unknown or other
  misc_feature (565)..(565): n is a, c, g, or t
  modified_base (577)..(577): a, c, t, g, unknown or other
  misc_feature (577)..(577): n is a, c, g, or t
  modified_base (623)..(623): a, c, t, g, unknown or other
  misc_feature (623)..(623): n is a, c, g, or t
tcagatacgacgtacacgaccggtgctcgatttagagagagtgtgttagggacttataaccgttgtctcctgtaccaacaacacccaggcgaaagcccccaaactcatgaatttangagggcactaagcggccctgtagggtttcttatcgcttactcgtaggcctaccgagttcgtggaccaaccgacggtcctaccccgtgaactactactccgtacggcctaccggaggtcctagaacgggacggaaggccggtaattattaacgtggttgacctacaattagtacgggaaccggggtatacggtaccgttaacgtttcgaacgttcgttaccgtttaagttccgggacgggaacggaacctaacggaccgttaccgaccggtaccgttacggtacctaggaaccctaaggtccctaacccggtcccccgtacggttacctacccgttaccgttccgttacccctaccccgttaccttacgtaccgtaacgttcgtaccgtggaccggacgtccgtacggagaaccgggctaaacgggctttaaagcgggaactcgtaaacncgtacagacgtntacggacgtaatacgtacgacgacagacactacgtagctacgatanacgtaggagaacgtacgtacgacgaagtagaacgacgtaactacgtaacgacgtacgtagatacgaccgaaccgttacggtaacgttaacgtaagtaccgtaacggtaacgacctaacggtagtactaacg

SEQ ID NO: 61085 - DNA, 469 bp, Homo sapiens
  misc_feature: GYAE6OF01AHSJI.36.6.A06.1.454.CMB.1.raw
  modified_base (452)..(452): a, c, t, g, unknown or other
  misc_feature (452)..(452): n is a, c, g, or t
  modified_base (456)..(469): a, c, t, g, unknown or other
  misc_feature (456)..(469): n is a, c, g, or t
tcagtacgctgtctcacgaccggtgctcgatttagatctactgacagggaggatggagactgggtcatccagatgacccagtctccatcctccctgtctgcatctgttggagacagagtcaccatcacttgccgggcaagtcagagcattagccactttttaaattggtatcagttcaaaccagggaaagcccccaggctcctcatctacggtgcgtccagtttgcagagtgggtcccaacaaggttcagtggcagtggatcggggacagatttcattctcaccattaacagtctacaacctgaagattttgcaacttactactgtcaacagagttacattactcctcggacattcggccagggaccaaggtggaaatcaaacgactgtggctgcacatctgtcttcatctcccgcatctgagacagcgtactgagcgggctggcaaggcgnatgnnnnnnnnnnnnnn

SEQ ID NO: 61086 - DNA, 615 bp, Homo sapiens
  misc_feature: GYAE6OF01DDYIS.36.6.A06.1.454.CMB.1.raw
  modified_base (193)..(193): a, c, t, g, unknown or other
  misc_feature (193)..(193): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (365)..(365): a, c, t, g, unknown or other
  misc_feature (365)..(365): n is a, c, g, or t
  modified_base (599)..(600): a, c, t, g, unknown or other
  misc_feature (599)..(600): n is a, c, g, or t
  modified_base (602)..(615): a, c, t, g, unknown or other
  misc_feature (602)..(615): n is a, c, g, or t
tcagtacgctgtctcacgaccggtgctcgatttagatctactgacagggaggatggagactgggtcatccagatgacccagtctccatcctccctgtctgcatctgttggagacagagtcaccatcacttgccgggcaagtcagagcattagcctactttttaaattggtatcagttcaaaaccagggaaacncccccaggctcctcatctacggtgcgtccagtttgcaggagtggggtacccaanaaggttcaggtggcagtggagtcggganagtatttcattctcacattaacagtctaacaacctgaagtattttgactaaactttactatcgtacaaacagtaagtttacaactttacncctacgggaactaagttccggaccgtaaggggaacctaaagggtaggaaaactcgaaaaacggtaactggtacggcgtacggacctaaccgtacttacgttgttacctttactaacttcccctttaccccggacctacgttaccgtaacggaaacgaccgtaacggtaccggtttaaccgagggtacgggccggggtaccgtacgggaaccgaaacgggccggacaagtacganngnnnnnnnnnnnnnn

SEQ ID NO: 61087 - DNA, 501 bp, Homo sapiens
  misc_feature: GYAE6OF01CG31Q.36.6.A06.1.454.CMB.1.raw
  modified_base (322)..(322): a, c, t, g, unknown or other
  misc_feature (322)..(322): n is a, c, g, or t
  modified_base (489)..(501): a, c, t, g, unknown or other
  misc_feature (489)..(501): n is a, c, g, or t
tcagtacgctgtctcacgaccggtgctcgatttagatctactgacagggaggatggagactgggtcatccagatgacccagtctccatcctccctgtctgcatctgttggagacagagtcaccatcacttgccgggcaagtcagagcattagccactttttaaattggtatcagttcaaaccagggaaagcccccaggctcctcatctacggtgcgtccagtttgcagagtgggtcccaacaaggttcagtggcagtggatcggggacagatttcattctcaccattagcagcctgcagcctgatgtattttgactaaaatnttactgccagcaaatataatacgtattggacgttcggaccaaagggccaggggtgagatacgaaacgactgtggctgacaccatctgtcttcactccttcccgcctatctagaacgacaggtccgtactggacggccgggtctcgggacaagggccgacgagtacgnnnnnnnnnnnnn

SEQ ID NO: 61088 - DNA, 678 bp, Homo sapiens
  misc_feature: GYAE6OF01DBV8L.36.6.A06.1.454.CMB.1.raw
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
  modified_base (325)..(325): a, c, t, g, unknown or other
  misc_feature (325)..(325): n is a, c, g, or t
  modified_base (367)..(367): a, c, t, g, unknown or other
  misc_feature (367)..(367): n is a, c, g, or t
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
tcagtacgctgtctcacgaccggtgctcgatttagatctactgacagggaggatggagactgggtcatccagatgacccagtctctatcctccctgtctgcatctgttggagacagagtcaccatcacttgccgggcaagtcagagcattagccactttttaaatggtatcagttcaaaccagggaaacgcccccaggcctcctcatctacggtgcgtccagtttgcagagtgggtcccaanaaggttcagtgcagtggatcggggacagatttcactctcaccntcagcagcctgcagcctagaagattgtagactaaactttnttattagtactaaaaagttataaacgagttccgacccccgtntaccgtaaccgttttcggggacgggtaacggggtaaccctaaaggggttcgggaacgtaacgttaacccgaaaaaccggtaaacgtttcgggtacgggtacctttacggaacccgtaacctacgttccgtttacggtttacctttaccgaacgttttccccgtttacccccggacctaacggtttactaacgggtaaacgtaccgtaacggttaccggttaacgtagggttaaccgggccggggtacttacggggaaccgaaacggggtccgaaccggtaacgttaggcacgacgngagananancngngn

SEQ ID NO: 61089 - DNA, 723 bp, Homo sapiens
  misc_feature: GYAE6OF01DXJ9I.36.6.A06.1.454.CMB.1.raw
  modified_base (208)..(208): a, c, t, g, unknown or other
  misc_feature (208)..(208): n is a, c, g, or t
  modified_base (702)..(702): a, c, t, g, unknown or other
  misc_feature (702)..(702): n is a, c, g, or t
  modified_base (712)..(712): a, c, t, g, unknown or other
  misc_feature (712)..(712): n is a, c, g, or t
  modified_base (714)..(714): a, c, t, g, unknown or other
  misc_feature (714)..(714): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
  modified_base (721)..(723): a, c, t, g, unknown or other
  misc_feature (721)..(723): n is a, c, g, or t
tcagtacgctgtctcacgaccggtgctcgatttagatctactgacagggaggatggagactgggtcatccagatgtacccagtctccatcctccctgtctgcatctgttggagacagagtcaccatcacttcggccgggacaagtcagagctattacgaccttaacttttttaaattggtattcagttaccaaaccgacgggaaaccncccccgaggcctcctacactccgtacgggtcgtccgttcctaggtttcgacgaggtacgggttccgggtacccaaacggtaagggttcaggtcggactagggtgggaacggtacgggggaactaggttctttacacttcctacgtaaccttaattaaccgtacgttaccgtaactaacccgtttaggtaaagtttacgttttacaacgttaacctttaccgttactacgttaaccaaacgttacggtaaacgtttacctaacgtttaccgtcccgtaacgggtaccttaacgttcccgggtaccggtaaggggtaacccgtaaagggtaacggtaaaactaccggaaaaacggtaccgttgggtacggtacctacgacctacgtacttacgttcgttacgttctaacttccctccgtactatcgtagacacgtacgacgtcgaggacggtccgggcgttaggaccgtaagggacctagtaagtcgagcgagtcntacgatcgancncanancnnn

SEQ ID NO: 61090 - DNA, 619 bp, Homo sapiens
  misc_feature: GYAE6OF01BHOVY.36.6.A06.1.454.CMB.1.raw
  modified_base (189)..(189): a, c, t, g, unknown or other
  misc_feature (189)..(189): n is a, c, g, or t
  modified_base (318)..(318): a, c, t, g, unknown or other
  misc_feature (318)..(318): n is a, c, g, or t
  modified_base (368)..(368): a, c, t, g, unknown or other
  misc_feature (368)..(368): n is a, c, g, or t
  modified_base (590)..(590): a, c, t, g, unknown or other
  misc_feature (590)..(590): n is a, c, g, or t
  modified_base (596)..(596): a, c, t, g, unknown or other
  misc_feature (596)..(596): n is a, c, g, or t
  modified_base (605)..(606): a, c, t, g, unknown or other
  misc_feature (605)..(606): n is a, c, g, or t
  modified_base (611)..(611): a, c, t, g, unknown or other
  misc_feature (611)..(611): n is a, c, g, or t
  modified_base (613)..(615): a, c, t, g, unknown or other
  misc_feature (613)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagtacgctgtctcacgaccggtgctcgatttagatctactgacagggagatggagactgggtcatccagatgacccagtctccatcctcctgtctgcatctgttggagacagagtcaccatcacttgccgggcaagtcagagcattagcctaatttttaaatggtatcagttcaaaccgagggaacnccccaggctcctgatcgtacggtgcgtccagtttgcagaggtcgggtacccaagtaaggttcagtgactgtggagtcgggactagtatttccattccgcacgattaacacgtactacacgtgaacgttnttttacgactaactttacgacgtgtacaacgagtacgttacacgtttccnccgtacggtactagtttcccggaccggtaaggggaacccgtaagggtacggtaaaactacgaaaacggtacttgggttagcttcggacctaacctgttctacgttctactaccggttcccttacccgacctacgtcgtaagaacgtactacggtacggttcacgggtacgggtccggtcggttaacgggacggaaccgggtcgaaccgtagttaggctaggnttccgnaaggttccnncagcncnnngngn

SEQ ID NO: 61091 - DNA, 617 bp, Homo sapiens
  misc_feature: GYAE6OF01DZXVF.36.6.A06.1.454.CMB.1.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
  modified_base (588)..(588): a, c, t, g, unknown or other
  misc_feature (588)..(588): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
tcagtacgctgtctcacgaccggtgctcgatttagatctactgacagggaggatggagactgggtcatccagatgacccagtctccatcctccctgtctgcatctgttggagacagagtcaccatcacttgccgggcaagtcagagcattagcctacttttttaaattggtatcagttcaaaccgagggaaacncccccaggcctcctcatctacggtgcgtcctagtttgcaggacggtcgggtacccaagtaaggttcaggtggcaggtggagtcggggacagtattcattcncactattacagtctacaacctgaagtnttttgactaacttactactgtacaaacgtagtaagttaactacttacctccgtacggactagtttccggaccgaacggggaactaaagggtacgaaaactaccgaaaacgtacgttggtaggtctagaccaactacgttacgttagttcctttcaaccctttccgttccccgtactacttcgtaacgtaacgtaacgacggtacgtaacgtacggacgggtccgggtacgtacgggaccgaacgggtcccgaacgttaacgtaggntacgagtcgagacnngncgcananngngn

SEQ ID NO: 61092 - DNA, 487 bp, Homo sapiens
  misc_feature: GYAE6OF02GCP4H.36.6.A06.1.454.CMB.1.raw
  modified_base (445)..(445): a, c, t, g, unknown or other
  misc_feature (445)..(445): n is a, c, g, or t
  modified_base (471)..(487): a, c, t, g, unknown or other
  misc_feature (471)..(487): n is a, c, g, or t
tcagtacgctgtctcacgaccggtgctcgatttagatctactgacagggaggatggagactgggtcatccagatgacccagtctccatcctccctgtctgcatctgttggagacagagtcaccatcacttgccgggcaagtcagagcattagccactttttaaattggtatcagttcaaaccagggaaagcccccaggctcctcatctacggtgcgtccagtttgcagagtgggtcccaacaaggttcagtggcagtggatcggggacagatttcattctcaccattaacagtctacaacctgaagtattttgactaactttactactgtcaaacagtagttacattactcctcggactattcggccaggggaccaaggtgaaatcaaaacgactgtagctgcacatctgtcttcatcttcccgctatctagaagacagcgtacngagcgggctggacaaggcgacagtgnnnnnnnnnnnnnnnnn

SEQ ID NO: 61093 - DNA, 593 bp, Homo sapiens
  misc_feature: GYAE6OF02FFXQF.36.6.A06.1.454.CMB.1.raw
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
  modified_base (582)..(586): a, c, t, g, unknown or other
  misc_feature (582)..(586): n is a, c, g, or t
  modified_base (588)..(593): a, c, t, g, unknown or other
  misc_feature (588)..(593): n is a, c, g, or t
tcagtacgctgtctcacgaccggtgctcgatttagatctactgacagggaggatggagactgggtcatccagatgacccagtctccatcctccctgtctgcatctgttggagacagagtcaccatcacttgccgggcaagtcagagcattagcctacttttaaatggtatcagttcaaaccaggaacgccccaggctcctcatctacggtgcgtccagtttgcagagtcgggtacccaacgaaggttcagtggcagtgggtctgggacagacttcactctcaccntcagcagactggancctgtaagtatttcgcgttagtacttactgtcaaactactaatcggtaccttcttctagttactacgtttgggaccgtacggggaaccaaggtctaggaagtaactaccgaaaccgtacgtggtacggtctcgacctaaccacttcttacgttccttaccctacttaccccgttaccccgtacctaacgttaccgttaacggaacgtaacccgtaacggttaccgttaacgttagggaaccggtcgggtaccgttacgggaccgacgggcgacgtaagagacnnnnncnnnnnn

SEQ ID NO: 61094 - DNA, 647 bp, Homo sapiens
  misc_feature: GYAE6OF02J2WD4.36.6.A06.1.454.CMB.1.raw
  modified_base (623)..(623): a, c, t, g, unknown or other
  misc_feature (623)..(623): n is a, c, g, or t
  modified_base (628)..(630): a, c, t, g, unknown or other
  misc_feature (628)..(630): n is a, c, g, or t
  modified_base (632)..(633): a, c, t, g, unknown or other
  misc_feature (632)..(633): n is a, c, g, or t
  modified_base (640)..(640): a, c, t, g, unknown or other
  misc_feature (640)..(640): n is a, c, g, or t
  modified_base (642)..(644): a, c, t, g, unknown or other
  misc_feature (642)..(644): n is a, c, g, or t
tcagtacgctgtctcacgaccggtgctcgatttagatctactgacagggaggatggagactgggtcatccagatgacccagtctccatccctccctgtctgcatctgttggagacagagtcaccatcacttgccgggcaagtcagagcattagcctactttttaaattggtatcagttacaaaccgagggaaacgcccccaggcctcctcactcgtacggtcgtcgtctacgtttgacagacggtcgggtaccaagtacggttcaggtgcgagtggacgtcggggactagtacgttcacttacgtcaaccttaattaacgtacgtacctaaacaacccgttaggaacttagttttctactaaccttactactcgtaactaagaggtaacttaactaacttacctccgtaccggtaaccttacgtttaccgggaccgtaacgggggtaaccctaaaagggtacggtaaaacgttaaccgaaaaacggtaaccgttggtacgtcgtcggtacctacctaacttcgttacgttacgttcctactacccgtcccgtacctacgtctacggaacgtagcgactacgcggtacgggcgtggtacgtacgaaccggcgatacgtagtcangtcgnnngnngagcgcncnnngcg

SEQ ID NO: 61095 - DNA, 581 bp, Homo sapiens
  misc_feature: GYAE6OF02HCFQK.36.6.A06.1.454.CMB.1.raw
  modified_base (306)..(306): a, c, t, g, unknown or other
  misc_feature (306)..(306): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(581): a, c, t, g, unknown or other
  misc_feature (576)..(581): n is a, c, g, or t
tcagtacgctgtctcacgaccggtgctcgatttagatctactgacagggaggatggagactgggtcatccagatgacccagtctccatcctccctgtctgcatctgttggagacagagtcaccatcacttgccgggcaagtcagagcattagcctaactttttaaattggtatcagttacaaaccgagggaaacgcccccaggcctcctcatcgtacggtgccgttcctagtttgcaggtaggtcggggtacccaaacgtaaggttcaggtggctaggtggagtcggggactagtatttcattccncaacctaattaacagtacctacaaccgtgaagtatttcgactaacttactactgtacaactagtattactacttactccgtacgactacgttcggacgtacggggaacaaggtagaaactacgaaacgtacgtggtgctacgactactacttcgtcgttccttctactcccttccgactagtctagaactcgagtcgtacgtcggacggtccgggtactacggaccgtacgggccaacgtagtacgnacgacgngcgnactcgtancncnnnnnn

SEQ ID NO: 61096 - DNA, 498 bp, Homo sapiens
  misc_feature: GYAE6OF01AHS66.52.42.D09.1.454.CMB.1.raw
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagcactgagaggccctcagggatccctgagcgattctctggctccaggtcagggacaacggtcacattggccatcagtggagtccaggcagaggacgagggctgactattattgtcaatcaacagacacctattggtacttagtgtcttcggactgcgaccaggtcacgtcngggtcacgcccaggcccaacccntgtacc

SEQ ID NO: 61097 - DNA, 501 bp, Homo sapiens
  misc_feature: GYAE6OF01AJ0PO.52.42.D09.1.454.CMB.1.raw
  modified_base (495)..(495): a, c, t, g, unknown or other
  misc_feature (495)..(495): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagcactgagaggccctcagggatccctgagcgattctctggctccaggtcagggacaacggtcacattggccatcagtggagtccaggcagaggacgaggctgactattatgtcaatcaacagacacctattggtacttatgtcttggaactgcgaccgaaggtcaccgtctcgggtcacgtcccaaggcccaacccntgtacc

SEQ ID NO: 61098 - DNA, 655 bp, Homo sapiens
  misc_feature: GYAE6OF01BZKND.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctctatgagctgacacagccaccctcggtgtcagtgtccccaggacagacggccaggatcacctgctctggagatgcattgaccaaacgatatgcttattggtaccagcagaagccggccacggcccctggtcgttggtgatgtataaagacactgagacgccctcgagggactcccgtaggacgcgtaacttcttcgtggtctccgaagggttccgaacggggtaaccaaacgggttaccgaacgtacgtttcgggaccctaacgttaccgaaggttacgggtaacggtacccgaagggacgaacgggaaacgggaacggaacggggccttagggtaaacctttaagtttattaacgtttacgaaactttacaaacgtaacgtaaccaaccgttagttacgggttaacttagttcgttcttacggtaactgacgaaccgtacggtcgacccgttcgtacggtacaccggtacccgaaccggtacccaaccccgtgtaccgtaccg

SEQ ID NO: 61099 - DNA, 529 bp, Homo sapiens
  misc_feature: GYAE6OF01AL3DX.52.42.D09.1.454.CMB.1.raw
  modified_base (241)..(241): a, c, t, g, unknown or other
  misc_feature (241)..(241): n is a, c, g, or t
  modified_base (521)..(521): a, c, t, g, unknown or other
  misc_feature (521)..(521): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcgagggactcccgtgacgcgtattctctggctcgaggtcagggacaacggtcacattggccatcagtggacgtccgaggcaggaggacgaggctgactattattgtacaatcaacacgacacctattaggtacttagtgtcttacggactggaccgtaacgacggtccaccgtccgtagggtccacggcccaaggaccccaaccccntcggtacc

SEQ ID NO: 61100 - DNA, 527 bp, Homo sapiens
  misc_feature: GYAE6OF01B9JTO.52.42.D09.1.454.CMB.1.raw
  modified_base (518)..(518): a, c, t, g, unknown or other
  misc_feature (518)..(518): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccgaggtcagggacaacggtcacattggccatcagtggagtccaggcaggaggacgaggctagacttagttattgtcaatcaacaagaccactattggtacttatcgtcttcgaactgaccgtaccgaaggtccaccggttccgtgggtacacggacccaacgggacccaaaccccncgtgtaccc

SEQ ID NO: 61101 - DNA, 659 bp, Homo sapiens
  misc_feature: GYAE6OF01EN4V0.52.42.D09.1.454.CMB.1.raw
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (567)..(571): a, c, t, g, unknown or other
  misc_feature (567)..(571): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggngatgcattgccaaaccgatatgcttattgacagcagagccggcacgcccgtngtggtagtatagtactaagtacgacgtggaccgtagacccggtacgtaccggtagaccgtacgacgtcgtcgttcgtcgtcggacgtccgagggtaccgaacggggtaccaacggtactacggacttacggtcgtagttacgaacggtcgggacggtccgaacgggacgaggacgggacgtaggtacgttagttaacttacgttactacgttacaaactacgaaaccgtaacgtaacgttaccgttaacgtttacggttacgtttacgtaccggttaaccgttacggacctnnnnnctaaacgggttaccgtaacccggttaccccgttacggggttacccgtaaccggtacccccgtaaaccgggtaccccgtaaaccccccg

SEQ ID NO: 61102 - DNA, 589 bp, Homo sapiens
  misc_feature: GYAE6OF01BM82X.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgttggtgatgtataaagacactgagagccctacgagggactccctgacgcgtattctcgtggctccgaggtcgaggggaccaaacggtcaacagtttcgggacctatccaggtcgggacgttccgagggccaaggacgggaacggagggctaggactatttattggtcaatacaacaagacaccgtatttgggttacttagtcgttacgttacgggaacttcggacgaaccgtaaacgggtcctacccggttccgtacgggtacccacggaccccgaacggaccccaaccccctagttccggtaaccc

SEQ ID NO: 61103 - DNA, 787 bp, Homo sapiens
  misc_feature: GYAE6OF01BT9SH.52.42.D09.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
tcagcgcagtacgacacgaccggtgctcgatttagacacatacgcagggaaagggggctgtgggtccaggaggcagaactctgggtgtcctcaccatggcctggatccctctacttctccccctcctcactctctgcacaggctctgaggcctcctatgagctgacacagccaccctcggtgtcagtgtccccaggacagacgccaggatcactgctctgganatgcattgccaaacgntatgcttattggtaccagccagaacgccgggccaggcccctgtcgttggcgtatggtataaagacactgagaggccctcgagggactcccgtgacgtcgattctcgtcggctccgaggtcaggggaccaacgggtcacgtagttcgggaccctagtaccgaggttacgggacgttccccgaagggccgaagggaagggtaacccggagggtcccttagggaaccctttaagtttagtttacgggttaccaaacgtttaccgaaaaccgaagggtaaccctaaacccggttaagtttttacggggttaaacccttttaaggttccgggtttacccgttttaacccgggggtaaaaccctttcggggtaaccccgggtaaaccccggttaaaacgggggttttacccccgtaaaaccccccggggttttccccggttaccggggggtttaaccccgaaccccggggttaaccccccccggtaaaaccgggggaaccccccccctaaaaaccccccccgggttaaccgttttcccggggttaaaccccccc

SEQ ID NO: 61104 - DNA, 542 bp, Homo sapiens
  misc_feature: GYAE6OF01D8GWM.52.42.D09.1.454.CMB.1.raw
  modified_base (424)..(424): a, c, t, g, unknown or other
  misc_feature (424)..(424): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacactgagacggccctcgagggactcccgtgagcgattctctggctccgaggtcagggacaacggtcactattcggccatcagtggatcgagcagaggacgagctgactattattgacaatcaanagacacctattacggtacttagtgtacgttcggaactcggacgaccgtaacggtccaccggttccgtaggggtccaacggtaccccaaacgggaccccctaaaccccgtgtcgtaccc

SEQ ID NO: 61105 - DNA, 585 bp, Homo sapiens
  misc_feature: GYAE6OF01DVW8N.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgaggcctcctatgagctgacacagcccacccgtcggtgtcagtcgtccccaggacaggacggccaggatcacctgctcgtggagatgcattcgaccaaacgatatgtcttattggtaccagcagaagccggccacggcccctgtgttggtgatgtaataaagacactgagacgccctagaggactcccgtgacgcgtattctcgtcggcctcgaggtcgaacgggacgaacggtcacgtagttcggccatcgagtggacgtaccgaggcaaggaggacggaggctagtaacttatttagtcgtacaactcaaacgacgaacctaaccgtatttacggttaacttaagttcgtacgttacggaattcgacgaaccgtaagtcctaccggttccgtacgggtacgaccgtcccggaaacgccccaaacccctgtcgtaccc

SEQ ID NO: 61106 - DNA, 588 bp, Homo sapiens
  misc_feature: GYAE6OF01ECOE6.52.42.D09.1.454.CMB.1.raw
  modified_base (245)..(245): a, c, t, g, unknown or other
  misc_feature (245)..(245): n is a, c, g, or t
tcagcgcagtacgacacgaccggtgctcgatttagacacatacgcagggaaagggggctgtgggtccaggaggcagaactctgggtgtctctaccattggcctggatccctctacttctccccctcctcactctctgcactaggctctgaggcctcctatgagctgacacagccaccctcggtgtcagtgtccccaggacagacggccaggatcacctgctctggagatgcattgccaaaaccgntatgcttattggtaccagcagaagccggcaggcccctgtgttggtgatgtataaagacactgagaggccctgagggactccctgagcgattctctgctccgaggtcagggacacggtcactattggccatcagtggagtccgaggcagaggacgaggctggacttattattgtacaatcaacgaacgaaccaacctatttacggttaacctttagtcgttaccgttacggtaaccttcggtaccgtaaccgtaacgggttccctaacccggttcccgttacggggtacccaaccggtacccctaaacgggaccccctaaaacccccgtcgtaccggttacccc

SEQ ID NO: 61107 - DNA, 652 bp, Homo sapiens
  misc_feature: GYAE6OF01DVZMI.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgctagttcgacccaaaccgtatatgtactttagttcgggtaaccagacgaaggaacggcccgggaccacggtccccctggttcggttggtagattaggtaataaacgacctacgtcggaagacggtccctacgaacgggtaactcccgtagacgtacgtattctacgtcggacctccgaggtacgagggactaacggtcacgtagttcggactagtcgtaggtacggacgtaccgaggcgaggacggacgagtcgtagtacttagttacgttaggtactaagtacaacgaacgtaacctaacgttaggttacgttaactttagtcgttacgtacggtaacgtcgaccgtacgtaaccggtcctaccggtcgtacgggtaccacccggtacccgaaccggaccccaacccgtcgtcgtacccg

SEQ ID NO: 61108 - DNA, 597 bp, Homo sapiens
  misc_feature: GYAE6OF01CORAE.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgcttattggtaccagcagaagcccgggccaggcccctgtgttggtgatgtataaagacacgtgagacggccctcgagggactcccgtgagcgtattctcgtggctccgaggtcgacggacgaacggtcactagttcggccatcaggtggacgtccgaggccaggagggacggacggctagaccttagttacgtttgtactaattacgaacaacggaaccctaacctagtttacggttaactttacgttcgttacgtttccggaactcggaccgtaacccgtacggtaccacccggttccgtacgggtaccacggacccctaacgggacccctaacccccgtgtccgtaccc

SEQ ID NO: 61109 - DNA, 625 bp, Homo sapiens
  misc_feature: GYAE6OF01CW24Z.52.42.D09.1.454.CMB.1.raw
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgcttagttcggtaccagcagaagccggccagcccctgtgttcggtnatgtaataaagacacgtgagacgccctgaggactccgngactcgtacttcgtcgtggcctacgaggtccgaaggggacctaacggtcaacgtacgttcggcctaattccgaaggtggacgttccgaggcaggacggacggagctagtaacttattagttcgtactaatacaactacgtaccaccgttattacggttacttaacgtgttaccgttacggaaccgtacggtacctaacccggtaacggttcccttaacccgggttccgttaccgggtacctaaccggacccccgttaaacggaccccccaaaacccccgtcgtcgttaaccccg

SEQ ID NO: 61110 - DNA, 655 bp, Homo sapiens
  misc_feature: GYAE6OF01B2XFT.52.42.D09.1.454.CMB.1.raw
  modified_base (226)..(226): a, c, t, g, unknown or other
  misc_feature (226)..(226): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgaccaaacgatatgcttattggtaccagacagaacggccggaccacggtcccctggtgttggtgtatagtaagtaaagacacgtgacgacggtccctacgagggtactcccgtgacgtcgtattcctcgtcggtcctccgtaggtaccgaacggggactaacggtcacgtacgttcggacctacgtacgaggtcgggtagtccggaggtacgaggaacgggacggaggtcgttaggaactttagttagttacgtactaacgttacaaactaacgaacctaaccgtagttacggttaactttatcgttacgttaccggaaactcggtaaccgtaacccgtaacgggttaccaacccggttccgtacggggttaccacccggtaacccggaacccggaacccctaacccctccgtcgtaccccg

SEQ ID NO: 61111 - DNA, 772 bp, Homo sapiens
  misc_feature: GYAE6OF01B4HM7.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctcctatgagctgacacacgcccacccgtcggtgtcagtcgtccccaggacaggacggccaggactcacctgctcgtggagatgctattcgaccaaacgatatgcttattggtacagcagaacgccggccacggcccctgtcgtggtgatgtaataagacacgtgagacggccctacgacgggtactcccgtaggacgcggtacttcgtcgtcggtcctacccggaggtaccgaacggggaaccgtaaaccgggttaccaacgtacgtttaccgggaccctaacgtaccgtaagggtacgggtacggtacccgaagggaccgaaggggaacggaaccgggtaacgggtaccgtaacggtaaccgtttaaagttttaacgttacggttaacctaaacgtttaacccgaaaaccgtaaccggaaccctaaacccgttaacgtttaacgggttaaaccttttaacggttacgttaccggtttaacgggtaaaccgttacgggtaacccggtaaacccgtaacgggtaccccgttaaccccgggttcccggttacgggttaacccgaaccccggtaacccggaaacccggtacccccgaaacccccctacggttcccgttaaccccg

SEQ ID NO: 61112 - DNA, 594 bp, Homo sapiens
  misc_feature: GYAE6OF01CFETV.52.42.D09.1.454.CMB.1.raw
  modified_base (329)..(329): a, c, t, g, unknown or other
  misc_feature (329)..(329): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttattggtaccagcagaagccggccaggcccctgtgttggtgatgtaataaagacactgagacggccctgagggactcccngacgcgattctcgtggctccgaggtcgaagggacaacggtcacattcggccaatcgagtggacgtaccgaggacaaggaggacggaggcgtagtacttaattacgttgtacgaatacaaacagtaaccaccgtaagtttcggttaacttagtgttaccttacggaacgttcgaccgtaaccgtaacgggtaccctaacccggttccgtcgggtaccaccggtaccccgaaaccggacccccaaaccccctacgtcgttaaccccg

SEQ ID NO: 61113 - DNA, 712 bp, Homo sapiens
  misc_feature: GYAE6OF01DA1PO.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggactcacctgctctggagatgcagttcgaccaaaccgtatatgtacttattcgtacagacaagaacgccggccacggcccctgtgttggtgatagtaataaagacacgtagagacgccctacgaggtactcccgtgaacgtcgtacttcgtacgtggtcctaccgaggtacgaacggggaaccgtaaaccgggtaccaacgtacgttaccggacctaacgtacgtacgggttacgggtaacggtacccgaagggtaccgaagggaacgggaacggtacgggaccgttacggtaaccgtttatttagtttacgtaactaaacttacgaaaaccaacggtaaccctaaccgttaagtttaccggttaactttacgttggttaccgttaccggtaaacgttcgtaccggaacccgtaacggtaccctaacccggttcccggtacgggtaccaaccggtacccccgaaacccggacccctaaacccccgtacgtcccggtaacccg

SEQ ID NO: 61114 - DNA, 582 bp, Homo sapiens
  misc_feature: GYAE6OF01BWACO.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaaccgatatgcttattggtaccagcagaagccggccacggcccctgtgttggtgatgtaataaagacactgagacggccctcgagggactcccgtgacgcgtattctcgtcggctccgaggtcgagggacaacggtcacgtagttcggacctagtcgaggtggacgtcccgaggcgaaggacggacgaggctagacttagttattgtacaatcaacacgactactagttacgttaacttagtcgttacgttacgtaacgtcggaccgtaaccgtaacggtcctacccggttcgtacgggtaccgaccgtacccgaaccggaccccaacccgtcgtcgtacccg

SEQ ID NO: 61115 - DNA, 598 bp, Homo sapiens
  misc_feature: GYAE6OF01AJNXB.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacaggacggccaggatcacctgctctggagatgcattcgaccaaaccgatatgcttattggtaccagcagaagccgggccaggcccctgtgttggtgatgtaataaagacactgagaggccctacgagggactcccgtagacggccgtattccgtcgtggcctaccgagggtccgacggggaaccaaacgggttccaacgtagttcggaccctagtccgaggttcgggagtcccgaagggcgaggacgggaacggagggtcgtagtacttaatttagttgtactaagtaccaacaggaaccactagttaggtacttagtgtcgttacgacgtgaccgaccgtaggtcctaccggtcgtacgggtcaccggtacccgaacggaccccaacccctcgtcgtaccc

SEQ ID NO: 61116 - DNA, 680 bp, Homo sapiens
  misc_feature: GYAE6OF01CWHXY.52.42.D09.1.454.CMB.1.raw
  modified_base (236)..(236): a, c, t, g, unknown or other
  misc_feature (236)..(236): n is a, c, g, or t
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgacggcctcctatgagctgacacacgcccaccctggtcgtcagtcgtccccgaggacacggacggccaggactccaccgtgctcgtgganagtgctatcgaccaacgatacgtgtacttagtggtaccagacaggaacggcccgggaccgaccgggtccccgtgggttacggttgggtagtaacgttaggtaaacgttaaacggaccgtaacgtacggaacggtaccgggaccctacggaacggggtacctacccggtaggacggtcgttaacgttccgtcgtccggcctaccggacgggtacgaacggggtacctaacggtcaacgtacgtcgacctagtcgaggtcggacgtaccgaggtcgaaggacggacgaggtctagtacttagttagttacgtactaactaacgtaacgaactaccgaacgttagttacgttactttagtcgttacgttacggactcggacgtaccgtacgtccgaccggttcgtacggtccaacgtcccgaacgaccccaccgtcgtacggtaccc

SEQ ID NO: 61117 - DNA, 524 bp, Homo sapiens
  misc_feature: GYAE6OF01A6AVD.52.42.D09.1.454.CMB.1.raw
  modified_base (426)..(426): a, c, t, g, unknown or other
  misc_feature (426)..(426): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctgagggactcctgagcgattctctggctccgaggtcgagggacaacggtcacagttcggccatcgaggtggagtccgaggcaggaggacgaggctagacttattagttgtanaatcaacagaccactattgtacttatgtcttacgatcgcgacgtacgtcctaccgtcgtcgggtcacgtacccaacggacccaacccctgtcgtaccc

SEQ ID NO: 61118 - DNA, 590 bp, Homo sapiens
  misc_feature: GYAE6OF01B8URX.52.42.D09.1.454.CMB.1.raw
  modified_base (226)..(226): a, c, t, g, unknown or other
  misc_feature (226)..(226): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgaccaaacgatatgcttattgtaccagcagaagccggcaggcccctgtgttggtgatgtataaagacactgagaggccctcgagggactccctggacgcgtattctctcggctccgaggtcgaggggaccaacggtcacagttcggaccatcgaggtggacgtccgaggcgaggaggacgaggctgacttattattcgacaatacaacacgaaccaacctagtttcggtaactttagtcgttacgttccggaaactcggacccgtaaccgtaaacgggttccctaacccggttccggtacgggtacccaccgtaccccggaacgggaccccccaaaccccgaccgttcggtaccccg

SEQ ID NO: 61119 - DNA, 686 bp, Homo sapiens
  misc_feature: GYAE6OF01D5AS9.52.42.D09.1.454.CMB.1.raw
  modified_base (226)..(226): a, c, t, g, unknown or other
  misc_feature (226)..(226): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgctattcgacccaaaaccgtatatgtactttagttcggtaaccagtacaaggaacgcccgggaccacggtccccctggttggttggtgagtgtaataaacgcacgtgacgacggccctacgagggtactcccgtagacgtcgtacttctcgtcggtcctccgtaggtacgaacggggtaaccgaacggtacaaccgtagttcggacctaagtccgaggtacgggagtacccgtaaggacgtaagggacgggaacggaggtcgttaacgaactttagtttaccgtagtactaaactacaaacgaacgtacgtaaggttaacgggttagtttaacgttaagttggtacgttacgtacgggttcggggaacgggtacgggtaacctaaggtcggtaccggtacccggtaccgtacggtacgaacccgacccggtaacggtcccgtccccgggtaccccccg

SEQ ID NO: 61120 - DNA, 576 bp, Homo sapiens
  misc_feature: GYAE6OF01CZP40.52.42.D09.1.454.CMB.1.raw
  modified_base (332)..(332): a, c, t, g, unknown or other
  misc_feature (332)..(332): n is a, c, g, or t
  modified_base (567)..(567): a, c, t, g, unknown or other
  misc_feature (567)..(567): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttattggtaccagcagaacgccggccaggcccctgtgttggtgatgtaataaagacactgagacggccctacgaggactcccgngagtcgtattctctggcctccgaggtcgacgggactaacggtcacgtacgttcggactagtcgaggtcggacgtccgtaaggacgaggaacgggacggaggcgtagacttattattcgtacaactacaacaagaccacgttagttacgttaacttagtcgttaccgttacggtacgtcgtacgaccgtaacggtccaccggttcgacggtcgacgtacccgacgacccaacccgntcgtacccg

SEQ ID NO: 61121 - DNA, 591 bp, Homo sapiens
  misc_feature: GYAE6OF01EN978.52.42.D09.1.454.CMB.1.raw
  modified_base (242)..(242): a, c, t, g, unknown or other
  misc_feature (242)..(242): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccggccaggcccctgtgttggtgatgtataaagacactgagacggccctcgagggactcccgtgagcgattctctggctcgaggtcagggacaacggtcactattcggcatcgagtggagtccaggcaggaggacgaggctagacttattattgtacaatcaaacagaaccaccgtaagtttggttaactttagtacgttccgttacggaaaccttggaacccgtaacccgtaaacgggttcccaaccccggttcccgttacggggtacccaaccggtacccccaaaacggggacccccaaaaccccccgtcgtacggttacccc

SEQ ID NO: 61122 - DNA, 691 bp, Homo sapiens
  misc_feature: GYAE6OF01CONI8.52.42.D09.1.454.CMB.1.raw
tcagcgcagtacgacacgaccggtgctcgatttagacacatacgcaggggtaaagggggctgtgggtccaggaggcagaactctgggtgtctcaccatggcctggatccctctacttctccccctctcactctctagcacgaggctctgaggcctcctatgagctgacacacgccaccctcggtgtcagtcgtccccgaggacacggaccggccaggatcacctgctctaggacatgctagttcgaccaaacgtattatgtacctttattcggtaccaggacaacggaacgcccgggaccaacggtcccccttagttcggtttcgggtgtacgtggtaactaaacgacctacgtaggacgtaacggccccttaggagggtaccttacccgtgtaacgtcgtaactttcgtacgtcggtcctccgaggtaccgaagggacctaacggtactacgtacgttcggacctacttacgaaggtcggacgttccgaggcaggaacggacgacggtcttagaaccttagttacttcggactaactaccgaacgacgtaccaccgttagtttaggttaaccttgttacgttacgtaccggtaacgtcggaccgtaaccgtacggttacccgaaccggtttccggtacgggttacaaccggtacccaaacgggttaccccaaaccccgtgtccgtacccg

SEQ ID NO: 61123 - DNA, 746 bp, Homo sapiens
  misc_feature: GYAE6OF01DDFHV.52.42.D09.1.454.CMB.1.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
tcagcgcagtacgacacgaccggtgctcgatttagacacatacgcagggaaagggggctgtgggtccaggaggcagaactctgggtgtctcaccatggcctggatccctctacttctccccctctcactctctgcacaggctctgaggcctcctatgagctgacacacgcccaccgtcggtgtcagtcgtccccgaggacaggacggccaggactcacctgctcgtgganatgcattcgaccaaacgntatgtacttatcggtaccagacaaggacggcccgggccgaccggtccccgttggttacggttggtaagtagttaagtaaactaaacgaccacgtacggaacggtacccgacccgttacggaacggtacctacccgtaggtacggtccgttaacttccgtacgtcgtaccgtacgacggtacggaacggtacgaccggtacaacgtagtcgacctagtaccgtaggtacggacgacggaggacgaacgggacggaacggacggtcgtaagtaactttagttagttaccgtaaacgtaactaaccgtaagaaccgtaacccttaacgtttaacggtttaaccgtttaacggtttacgtttaccggttaaccggtttaaccgggaaccgttaccggaaaccccgttaacggtaccggttacccgtacccgggtttacggtacgggaacccgacgtaaaccccgggaccctaacccccgtaaccttcgtacccgttaccccg

SEQ ID NO: 61124 - DNA, 596 bp, Homo sapiens
  misc_feature: GYAE6OF01EE369.52.42.D09.1.454.CMB.1.raw
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
tcagcgcagtacgacacgaccggtgctcgatttagacacatacgcagggaaagggggctgtgggtccaggaggcagaactctgggtgtctcaccatggcctggatccctctacttctccccctctcactctctgcacaggctctgaggcctcctatgagctgacacacgcccaccctggtntcagtcgtcccaggacaggacgccaggatcacctgctcgtgagatgctatcgaccaaacgntatgtcttagttgtaccagtcagaacgccggcacggccctgtgtgtgatgtataaagcacgtgagacgcctacgaggtactccgtgacgtcgtacgttctcgtggtccgtacgacggtacgacgggaacctaacggtccaacgtacgttcggacctagtccgtaggtggacggtccgaggtacgaacggacggaccgaggtacgtagtaccgtttaagttattacgttactaactaccgtaaacgacgaactaccgtaagtttacgtatttacgtcgttcgttaacgacgtcgacgtaccgtacgtacgacgtccgtaggccgacgtacccgaacgcccaactcgtcgtacccg

SEQ ID NO: 61125 - DNA, 678 bp, Homo sapiens
  misc_feature: GYAE6OF01CKAHJ.52.42.D09.1.454.CMB.1.raw
  modified_base (254)..(254): a, c, t, g, unknown or other
  misc_feature (254)..(254): n is a, c, g, or t
tcagcgcagtacgacacgaccggtgctcgatttagacacatacgcagggaaagggggctgtgggtccaggaggcagaactctgggtgtctcaccatggcctggactccctctacttcctccccctcctcactctctgcacaggctctgaggcctcctatgagctgacacagcccaccctggtgcagtcgtcccgaggacaggacggccaggactccacctgctcgtggagtatgactagttcgaaccaaacgtnttatgtcttaagttcggtacagacgaagaacggcccggacacggtccccgtggtcgttggtagtagtagtaagtaaacgactaacgtaggacgacggtacccgtaggaacgggacttacccgaggtaccgacgtacttccgtcgtacggtccgtacggtacggtacgaacgggtaacgaaccgggtactacgtagttcggaccaggtacgaggtacggacgtccgaggacgaagggacggaaggacggtacgtagtaacttagttaagtcgttaacaaagtacaaccgtaagaccgtaacttacgttacgttaacttagttacgtacgtacgttaacgcgtaccgaaccgttaacggcctaaccggtccggttaggaccaccggtaacccgtaacccgaccccgaaaccctccgtcgttacccg

SEQ ID NO: 61126 - DNA, 740 bp, Homo sapiens
  misc_feature: GYAE6OF01DKUDU.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgaggcctcctatgagctgacacagcccaccctcggtgtcagtcgtccccgaggacagacggccaggactcacctgctcgtggagatgctagttcggaacccaaaaccgtataatgtacctttagtcggtaaccagcaaggaacgcccgggaccacggtccccgttgtcggttggtagatagtaataaaacgacacgtaggagaccggtccctaggaacggactcccgtaggacgtacgtattcgtcgtacggtccgtacccgtagggtaccgaaacggggaacgtaaccgggtacctaacgtacggtttaccgggacctaacgtaccggtaagggttcggggtaacgtaccccggaagggtaccgaaagggacgggaacggacgggtacgttacggtaaacttttaagttatttacggtactaaacgtaccgtaaacacgtaaacctaccgttaagtttccgggttaaaccttagttacggttacccgtttaacgggaactcgtaaccgaaccgtaacggttaccgtacccggttacgtcgggtaccaccggtaccccgaaacggtacccccaaacccgtcgttcgtaaccccg

SEQ ID NO: 61127 - DNA, 705 bp, Homo sapiens
  misc_feature: GYAE6OF01BF00Z.52.42.D09.1.454.CMB.1.raw
  modified_base (230)..(230): a, c, t, g, unknown or other
  misc_feature (230)..(230): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctcctatgagctgacacagcccacccgtcggtgtcagtcgtccccgaggacaggacggccaggactcacctgctcgtgganatcgctagttcgaccaaacgtatactgtacttagttcggtaaccagtacgaaggaacggcccgggaccaccgggtccccttggttcggttggtacgagttaggtaaacgtaaacgactacgtaggaacggaccggtccccgtacgaacggggtaccttccccgtaggacgtacgtactttccgtcggtcggtcccgtaccggtacgggttaccgaacggggtaacctaaccggggttactaacgtacgtttcgggacctacgttaccggtacggtacgggtaaccgttaccggaaggtaccgaagggaaccgggacgggacgtccgtaggtaactttatttagttacgtacaactacaaacgtagaaccctaccgttagttaccggttaacttagtcgttacgttacgactcgaccgtaacgtacgtccaccggtcgtcggtacaccggacccacgaccccacctgtcgtaaccc

SEQ ID NO: 61128 - DNA, 839 bp, Homo sapiens
  misc_feature: GYAE6OF01A4CLM.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgacggcctcctatgagctgacacacgcccacccgtcggtgtcaggtcgtacccgagggacacggaccggaccgaggtactaccaccgtgactcgtaggagatcgactattcgaacccaaacgtatactgtacttagttcggtacacgacgacggaacggccgggaccgtaccggtccccgttggttcggttgggtacgtagttaggtaaagtaaacggactaacgtacggaacggtaccggtacccgtacggtaacggtaccgtcccggtacggacgtcgttaacttccgttcgtacggtccgtacggtacggtacggagggaaccgtaacggtccgaacgtacggttacggaccctaagtcggtaggtacgggtacgtaccggagggtaccgaagggaaccgggtaacggacggtaaccggttacgtaaacgtttaactttaggtttaaccgtaacgttaacgtaaccgaaacgtaaccggtaaccctaaaccgtttaagggttttacggttttaacgttacgtttacgggttaccggttaacccggttaacgacccgggttaaccggtaaccccggtaacgggttaccccgttacccggggttaccgggttaccgggaacccggtacccgtaaaaccccgggacccgggttaaaccccccaacccggttaaccgttccccgggttaacccc

SEQ ID NO: 61129 - DNA, 738 bp, Homo sapiens
  misc_feature: GYAE6OF01ATAC6.52.42.D09.1.454.CMB.1.raw
  modified_base (182)..(182): a, c, t, g, unknown or other
  misc_feature (182)..(182): n is a, c, g, or t
  modified_base (236)..(236): a, c, t, g, unknown or other
  misc_feature (236)..(236): n is a, c, g, or t
tcagcgcagtacgacacgaccggtgctcgatttagacacatacgcagggaaagggggctgtgggtccaggaggcagaactctgggtgtctcaccatggcctggatccctctacttctccccctctcactctctgcacaggctctgacggcctcctatgagctgacacagcccacccgtggtntcaggttcgtccccgaggaccaggaccggccaggactccacctgctcgtagganagtcggactagttccgaacccaaacgtattagtctactttagttcggtaaccaggtaccgaaggaaccggccccggggaccgaccgggtccccgttaggttcgggtttgggtagtagttacggtaaagttaaacgcgtacgtaggacggtaccggcccgtacgtacgggtacctcccgtaggacgtacgtacttcgtcgtcggtccgtacggtacgggtacgtacggggtaacctacggtacctaccgtagtaccggactacgtacgacgggtacggtacgtacggaacgggcgaagggacggtacggagtcttaggtacgtttattacgtacgtacaactaccgaacgacgtaaccctacgttaacgttacggttaacttacggttaccgttaccggttaacgtacggttacggaccgtaaccgtaccggttacccgtcggttacccggtcggtaccgtaccggaacccgaaccggacccctaacccgtgtacccgtaccc

SEQ ID NO: 61130 - DNA, 720 bp, Homo sapiens
  misc_feature: GYAE6OF01CGE0V.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggactcacctgctcgtggagatgctagttcgaccaaaccgattactgtcttagttcggtaccagacacggaacggcccgggaccgacggtccccgtggtcggttggtgagttagtaataaacgacgacgtggacggcggacccgtcggacgggtactcccgtgacgtcgtacttcgtcgtcggtcgtccgacggtacgacgggactaacggtcacgtagttcggacctagtcgtaggtcggacgtcgaggacgagggaacggacggacggcgttagtaacttagtttacgttagtacttaaacacgtaaacaacggtaccctaaccgttaagtttaccgggttaactttaacggttccgttaccggtttaaccggaccggttacggtaacccggtaacccggtaacgggttaccccgtacccgggttaccccggttacgggggtacccaacccgggtaacccctaacccgggaacccccctaaaccccggtaccgttcccggttaaccccg

SEQ ID NO: 61131 - DNA, 627 bp, Homo sapiens
  misc_feature: GYAE6OF01B8ATD.52.42.D09.1.454.CMB.1.raw
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgaggcctcctatgagctgacacagcccaccctggtgtcagtcgtccccaggacagacggccaggatccacctgctcgngganatgcattcgacccaaacgatatgtacttatcggtaaccagcaaggaacgccggccacggccctgtgtggtgtatgtaataaaggactacgtggagacggtccctacgaggtactcccgtgacgtcgtatcgtcgtcggctaccggagtccgagggtaccgaaacgtnacgtagttcggactagtcgagnggacgcgtaggacaggaggaccgaggtctagtaacgttattacgtacgtacaagtacaaacgagtaaccaccgttaagttacgttaacgttacgttacggtaccgttaccggaacgttcgaaccgtaacggtaaccgttccgaacccgggttcggtacggtacccaacggtaccccgaaacggaccccctaaccctacggtccgtacccg

SEQ ID NO: 61132 - DNA, 578 bp, Homo sapiens
  misc_feature: GYAE6OF01A5XSE.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgcattgaccaaaccgatatgcttattggtaccagcagaacgccgggccacggcccctgtgttggtgatgtataaagcacgtgagaggccctcgagggactcccgtgacgcgattctcgtcggctccgaggtcaaggggaccaacggtcaactagttcggcctagtcgagtcggagtccgaggcgaggaggacgaggctagtactattgtcgtacaatcgaacagacctacctattgggttaacttagtcgttacgttacggagtacgacgaacccgtaggtcccacccggttcgttacgggtaccaaccggtacccgaacggaccccaaaccccctagtcggtaaccccg

SEQ ID NO: 61133 - DNA, 834 bp, Homo sapiens
  misc_feature: GYAE6OF01C53CZ.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggccctcctatgagctgacacagcccacccgtcggtgtccagtcgtccccgagacagacgccagactcacctgctcgtaggagatgactattcgaccaaaccgtatatgtctttagttcggtaaccagacaaggaacgcccgggacctaccggtcccctggttggttcggtagtagttacgtaataaagacctacgtaggacgaccggtccctaggaacggtacctccgtagagtcgtactttcggtacgtcggtccctacgacgggttaccgaacggggtacctaacggttacgaaccgttagttccgggtaaacctcgttacccggtaagggttaacggggtaccgttaacccgggaggaaccggtaaaggggaaaccggggaccggtaagggtaccgtttacgttaaacgtttaacttttaacggttactaaccgtaaacgtttaccaaaaaccggttaacgtaacccttaaccgttaggtttaaacgtttaacccgtttttaacgtaccgggtttaacccgttaaccggggttaacccgtaccggtaaacccgtaaacccgggtaaccgggttaaccccttacccccggggttttcgtaaacccgggttaccccgaaaccggtaacccccccggaaacccggtcccccccgaaaaacccccgttgtacccccggttaaccccg

SEQ ID NO: 61134 - DNA, 535 bp, Homo sapiens
  misc_feature: GYAE6OF01A7AFG.52.42.D09.1.454.CMB.1.raw
  modified_base (526)..(526): a, c, t, g, unknown or other
  misc_feature (526)..(526): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgaccacagcccaccctcggtgtcagtcgtccccaggaccagacggccaggatcacctgctctggagatgcattgaccaaacgatatgcttattggtacccagcagaagccgggcacggcccctgtgttggtgatgtaataaagacactagagaggcccctcgagggactcccgtgacgcgattctctggcctccgaggtcgagggaccaacggtcacattcggccatcagtggacgtccgaggcaggaggacgaggctgaactagttattgacaatcaacgaagacacctattagtacttatcgtcttcgactgcgaccgtaaggtccacggtcctacggtcacgtcccgaacgcccaaccccnctcgtaccg

SEQ ID NO: 61135 - DNA, 675 bp, Homo sapiens
  misc_feature: GYAE6OF01AIYC7.52.42.D09.1.454.CMB.1.raw
  modified_base (353)..(353): a, c, t, g, unknown or other
  misc_feature (353)..(353): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgagcctcctatgagctgacacagcccaccctggtgtcagtcgtccccaggacagaccggccaggactcacctgcctcgtggagatgcattcgacccaaaccgtatatgtacttagttcggtaccagcaggaacggcccggccgacggccccttgttcggttgtgatagtaataaagactagtagagacgcccgtacgaggtactccgngagcgtattcgtacgtcggtcctccgacggtcgagggaccgaaccggtcacgtagttcggacctagtcgaggtcgtacggtccgaggacgaggacggtacggacgggtctacggtactttagttacgttacgtactaactacgaaacaacgtaacgaaccgttagtttacggttaacttcgttacggttaccgttacggtaaacgttccggtaaccggtaccggtaaccgggtacccgttacccggttcccggttacgggtacccgtaacgggtacccccggaaccgtaacccccgtaacccccgcgttcccgttaaccccg

SEQ ID NO: 61136 - DNA, 769 bp, Homo sapiens
  misc_feature: GYAE6OF01ELVCQ.52.42.D09.1.454.CMB.1.raw
tcagcgcagtacgacacgaccggtgctcgatttagacacatacgcagggaaaggggctgtgggtccaggaggcagaactttgggtggtctcaccatggccgtcgagtccctcctacttcctcccccttccctcactctctgcgacaggctctgacggcctcctatgacgctcgacacacgccacccgtcggtgtcagtcgtcccagacacgacggccaggatccaccgtgcgtctaggagatgcattcgaaccaaacgtatagtcgtactttagtacgtaccagacgaacggtaacggcccggaccgaccggtcccttcggttaggtttcgggtagtaacgttaacgttaaacgtaaaacggtaaccgacgtaggacggaccggtacccgtaacggacgggtaacttccccggtagaacgtccgttaacttcgtcgtacggtaccctcgtacgggtacgaacggtaacggtaaccgtcgaacgtaggtaccgactagtacgtacggtacggtacgtaccgaaggacggaaggaacgggacggtacgtacgtaccggtaattaacgttttacgtacgtaactaacgtacaaacgtaacaaccgttacgtaacgtttacgttaacttacgttacggttaccgtttaaccggaaaccggttcggacctaaacccggtaccggtacccgaccgggtttaccggccggtaaccgtacccgaaccccggttaccggaacccccaaaccccggttcgttaccgtcccttaccccgg

SEQ ID NO: 61137 - DNA, 732 bp, Homo sapiens
  misc_feature: GYAE6OF01B0HAI.52.42.D09.1.454.CMB.1.raw
  modified_base (184)..(184): a, c, t, g, unknown or other
  misc_feature (184)..(184): n is a, c, g, or t
  modified_base (617)..(617): a, c, t, g, unknown or other
  misc_feature (617)..(617): n is a, c, g, or t
  modified_base (675)..(675): a, c, t, g, unknown or other
  misc_feature (675)..(675): n is a, c, g, or t
  modified_base (719)..(719): a, c, t, g, unknown or other
  misc_feature (719)..(719): n is a, c, g, or t
  modified_base (724)..(724): a, c, t, g, unknown or other
  misc_feature (724)..(724): n is a, c, g, or t
  modified_base (727)..(727): a, c, t, g, unknown or other
  misc_feature (727)..(727): n is a, c, g, or t
tcagcgcagtacgacacgaccggtgctcgatttagacacatacgcagggaaagggggctgtgggtccaggaggcagaactctgggtgtctcaccatggcctggatccctctacttcctcccctcctcactctctgcacaggctcgtgacgcctcctatgagctgacacacgcccacccgtggtntcagtcgtaccccgaggacgacggaccggccaggactccgacctgcctgtaggatagtcgtactacgtacgaacccaaacgtattacgtacgtactttaacgttaccgggtaaccaaggacgtaaacgggaaccggtccccggggtaccccgtacccgggttcccccgttaggggtttcggtttcgggtaacgttaaaggttacgttaaaaacgttaaaacggaccgaaccggttacgggaaacgggaccggttaccccgtacgggtaaccgggtaccttacccggtaggaaccggtcgtaactttccgtcgtaccgggtaccctttacccggaaggttccggaaacgggtaaccgtaaacggtactaacgtacggttcggtaactcgtacggtagtaccgggtacgtaccgaggtacgaaggacggacggtntcgtaagtatttagttagttacgtaacactaacgtacaagtacctatgttacgtattntcgtagtcgatcgactacgcgtctacggtcagtcacgacccganacccnctncgtac

SEQ ID NO: 61138 - DNA, 673 bp, Homo sapiens
  misc_feature: GYAE6OF01A71IH.52.42.D09.1.454.CMB.1.raw
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggcaggactcacctgctctggagatgcattcgaccaaacgatatgtcttattggtaccagcacggaagccgggaccaggcccctgtggttggtgattgtaataaacggactacgtggagcgaccctgagggacctccctaggacgcgtacttcgtctggtccnccgagcgagggacaacggtcanagttgaccgtatcgngtagacgtcgaggcaagaggacggaggcgagtaacgtattatagtacgtaatcctaaagaccgtacgaacccgtagtttacggttaactttacgtacgttacgttaaccggtaacgttccggtaaccgtaacccggtaaacgggttacccgtaaacccgggtttccccggttaccgggggttaacccgttaaaccccgggaaacccccgggtaaacccgtaaccccccggtaaaccccccgtaacccggtttaacccggtaacccccg

SEQ ID NO: 61139 - DNA, 861 bp, Homo sapiens
  misc_feature: GYAE6OF01E3AKQ.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacacgcccacccgtcgggtgtcagtcgtccccaggacagacggccaggactcacctgctcgtggagatgctattcgacccaaaccgatactgtcttattacggtaccagacgagaacggcccgggtaccacggtccccgtggtggtttggtagtagttagtaaagtaaacgacgtacgtggaacggtaccggtcccctacggacgggtacttcccgtaggtacggtaccgttacttccgtcgttcgggtccgttacccggtaacggggtaccggtaacgggggtaacccgaaacccggggttacaaccgtaggtttaccgggaccctaagtcggtaacgggttcggggtaaccggtcccggtaaggggaccgaacgggggacgggtaaccgggtacgggtaccgttaacggttaacgtttaaacgttttacgttaacggttacctaaaactaacgaaaccgtaacgtaaccctaacccggttaagttttaacgggtttaaaccttttacgttacgggtttaacccgtttaaccgggaaaccggtttacccgggtaaacccggaaacccggttaaaccgggttaacccccgttaaccccgggttcccgggtttaacggggtaaccccgaacccgggtaaccccccggaacgggtaaacccccccctaacccccgttaaccgttccggttaacccccg

SEQ ID NO: 61140 - DNA, 786 bp, Homo sapiens
  misc_feature: GYAE6OF01EYV39.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgaggcctcctatgagctgacacacgcccacccgtcggtgtcaggtcgtccccaggacaggaccggccaggactccacctgcctcgtgggagtatgctattcggaacccaaaaccgtattatgtactttagttacgggtaccagcgaaggaacggcccggggaccaccgggtcccccttgggttcggtttgggtacggtacgtttaggttaaacgtaaaacggtaacctaacgtaggaacggaccggtccccgttaacggaacggggtaccttccccgtaggacgtaccggttaacttttccgtccggttcggtaccgttacccggtaacggggttaccggaacggggtaaaccgtaaacccggtaccgaaccgttagtttccgggaccctaagttaccgtaagggttcgggaaccgttaccggaacgggtacgacgggaacgggaccggacgggtacgttacgtaaccgtttagtttagttacgtaactaacgtacaaacgaacgtaacctacgttaagtttacgttaacttacgtacgtttacgtacggtaactcgaccgtaacgacgggttaccctaccggttccggtacggtccgaaccggaccccgaaccgaccccctaccgtcgtccgttacccg

SEQ ID NO: 61141 - DNA, 646 bp, Homo sapiens
  misc_feature: GYAE6OF01A54JE.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgctattcgaccaaaccgatatgtactttagttcggtaaccagcaagaacggcccgggaccacggtcccctgttggttggtgagttgtaataagacacgtggacgacggccctacgaggacttcccgtggagcgtattcgtcgtgctccgaggtacgagggacacggtcacgtagttcgactagtacgaggtggacgtaccgaggacacgggacggtacggaggtccgttagtaacctttaagtttacgttacgtactaactaccaaacgtaacgaacctaaccgttagtttaacggttactttaataccggttacgttacggaacttcggaacccgtaaccgtaacggtacccgtaccggttccgtacgggtacccaaccggtaccccgaacggtaccccccaacccgtcgtcgtacccc

SEQ ID NO: 61142 - DNA, 724 bp, Homo sapiens
  misc_feature: GYAE6OF01BFPLN.52.42.D09.1.454.CMB.1.raw
  modified_base (265)..(265): a, c, t, g, unknown or other
  misc_feature (265)..(265): n is a, c, g, or t
  modified_base (568)..(568): a, c, t, g, unknown or other
  misc_feature (568)..(568): n is a, c, g, or t
  modified_base (580)..(580): a, c, t, g, unknown or other
  misc_feature (580)..(580): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctctatgagtctgacacagcccacccgtcgggtcgtcaggttcgtccccgaggaccaggaccggccaggactccacctgcctcgtaggagatcggactattacgacccaaaacgnttaagtgtactttagttcggtaaccgagtacgaacggaacggcccgggtccgaccgggtccccttaggttcggtttacggtagtattacggtaataaacggaccacgtaggacggtacggtcccgtaacggaggtactacccgtggacgtcgtactttccgtacgtcggtacctaccggacgggtacgaggggaaccgtaacggtcgacgtacgttcggacctagtacgagggtacggaccgtacggagggtacgaacgggacgggaccgggagtccgtaagtaacgttattacggttactanaacttaccgaanaacggtacctacggtaagtttaccggtactttacgtagttaccgttacgggacttcggaaccgtaccgtaacggtccgaaccgtttccggacgggtacccacccggtaccgaacccggaaccccaacccgtcgtaccgtacccg

SEQ ID NO: 61143 - DNA, 663 bp, Homo sapiens
  misc_feature: GYAE6OF01E1GT8.52.42.D09.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggccctcctatgagctgacacagcccaccctcggtgtcagtcgtccccaggaccagacggccaggactcacctgctctgganatgctatcgaccaaaccgntactggcttattggtaccagccgagaacgcccgggccaggcccccgttggagttagtttagtagaagtagtaacgacgacgtacgtacgacgaccgtacgacggacgtaccgtcgtacgtacgtacgtcgtcgtcggtacgtaccgtacggtacgacggacgtaacggtacgtacgtacgtacgtacgtacgtacgtacgtacggacgtacgacggacgacggacgacgtacgtacgtacgtacgtacgtacgtactactaactacgtaacgtacgtacgtaaccgttacgttacgttacgttacgtacgtaccgttaccggtaaccgtacgtaccgtaccgtacgtaccggtacccggtaccgtaccggtacccgtaccgtacccgaacccgaccccgtaacccgtaccgtccg

SEQ ID NO: 61144 - DNA, 741 bp, Homo sapiens
  misc_feature: GYAE6OF01EGA9A.52.42.D09.1.454.CMB.1.raw
tcagcgcagtacgacacgaccggtgctcgattttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccgaggaccgagacggccaggatccacctgctctaggagatcgcattcgacctaaaccgatatgacttagttcgtaccagacgagaacggccggccacggcccctagtggttaggtggtatgtaattaaacgactacgtacgtagacggtccccttagaacgggtctccccgtaggacgcgtactttcgtcgttcggacctacgtacggtacggaacgggtaccgaacggtctaacgtagtacggtccctaagtcctaagggtacggtacgtacccgaagggccgaagggtaacgggaaccgaaccggggtcttaaacgggtacctttaagttttaaccgtttggtaacctaaataccgtaaaaccgtcgtaaacccgacccttaaagttttaccgggtttaactttaacgttaccgtttacggttaaccggttaaccacgggtaacccaaaccggttaacgggtccccgttaacccggtttcccgggtacgggtacctacccggaaccccgtaccggaaccccctaaccccggtctacccgtaacccg

SEQ ID NO: 61145 - DNA, 744 bp, Homo sapiens
  misc_feature: GYAE6OF01B9M5J.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgaggcctcctatgagctgacacacgcccaccctcggtcgtcagtcgtccccaggacaggaccggccaggactcacctgctcgtggagatgctattcgacccaaccgatatgtcttagttcggtacctagacgaggaacggcccgggaccacggccccttggtcggttggtgtagtagtaagtaaacgaaccgtacgtacggaacggtaccggtaccccgtacggacgggtactcccgtaggaacgtccggtactttaccgttcgtacggtaccgtaccggtacgggtaccgtaaggggaaccctaaccggtaccgacgtacgttccggaccgtacgttacgtaacggtacgggtaccgtaaccggagggtacggaagggtaacgggaccggacggtacgtacggttactttaagtttcgttacgtaacgtaactaaccgaacgtaacgtaaccctaacttacgtttagttaacgtttagttacgttaccgtaacggtacttacggaaccgtaccggtaacggtccgtaacccggttccggtaacgggtccaacccggtacccgaacccggtaccccaaacccgtccgttcgtaccccg

SEQ ID NO: 61146 - DNA, 826 bp, Homo sapiens
  misc_feature: GYAE6OF01DF08I.52.42.D09.1.454.CMB.1.raw
  modified_base (160)..(160): a, c, t, g, unknown or other
  misc_feature (160)..(160): n is a, c, g, or t
  modified_base (184)..(184): a, c, t, g, unknown or other
  misc_feature (184)..(184): n is a, c, g, or t
tcagcgcagtacgacacgaccggtgctcgatttagacacatacgcagggaaagggggctgtgggtccaggaggcagaactctgggtgtctcaccatggcctggatccctctacttcctccccctctcactctctgcacaggctctgacgcctcctatganctgacacacgccctaccgtcggtntcacgtcgtccccgaggacacggccggccgaggactccaccgtgccttcgtaggatacgtcgactacgttaccggaaccctaaaccgtattagtacgttactttaacggttcggtaacccacggaaccgaacggtaaccgggccccgggacccgtaaccggtccccgttggttggtttacggtagtaagttacggtaaaagtaaccggaacgtacggtacggaacggtacccgtaccgtaacggaacggtcccttaccggagtaccggtccttacgttccttacggtccggtacccgttacggtacggtacggtaaccgggaacccgtaacggtacctaacggttcgtaccggactacgttagggacggtcggtaaccgacccggtaaggacgaacgggaacgggtaccggacgttacgttacgtaaacgtttagttactttaacgaaccgtaaaccgttaacaaaccgtaacggttaacccttaaccgttagtttacgttaactttaccgtcgttaacccggttaggaccgtaccgtaaccgttaacggacccgttacccggttaccggttcggtacccggtaaccctacccggaacccgtaaaccccctcccgtaaacccgttgtaccccgttaaccccg

SEQ ID NO: 61147 - DNA, 798 bp, Homo sapiens
  misc_feature: GYAE6OF01B0UIE.52.42.D09.1.454.CMB.1.raw
  modified_base (241)..(241): a, c, t, g, unknown or other
  misc_feature (241)..(241): n is a, c, g, or t
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgacggccctcctatgagctgacacagcccaccctcggtgtcagtccgtccccgaggacacggacggccaggactccaccgtgactcgtaggagtntgactattccgaacccaaaccgtatacgtgtacgtttagtacggtaacccaggtccgaacggaacggccccggggacccgacggtcccccggttggtcggttgggtagtagttagtaactaaaacgccgtaacgtggacggtaccggtacccgtacggacgggtacctccgtggacggtcgtactccgtcgcgtacctccggacggtaccggacggtacgaacgtacagtaacgtcgtacctacgtacggtaggtcgggtacgaccgggtacgacggacggtaacgggacggacgggtactacggtaaccgtttaagtttacgttacggtaacctaacgtaaccgtaaacgtaaccgaccctaaaccggtttcttaaaggggttttaaccttaacgtttaccggttacggtttaacccggtaccggttaccggaacccggttaaacccggtaaccgggttaccccggacccggtttcccggccggggttaacaacccccgggtacccggaaaccccggtaccccccaacccctttaaccgggttccttaacccccgg

SEQ ID NO: 61148 - DNA, 856 bp, Homo sapiens
  misc_feature: GYAE6OF01BBXAY.52.42.D09.1.454.CMB.1.raw
  modified_base (140)..(140): a, c, t, g, unknown or other
  misc_feature (140)..(140): n is a, c, g, or t
tcagcgcagtacgacacgaccggtgctcgatttagacacatacgcagggaaagggggctgtgggtccaggaggcagaactctgggtgtctcaccatggcctggatccctctacttcctccccctcctcactctctgcacnggctctgacggcctcctatgagctgacacagcccaccctggtcgtcacggtccgacccgaggacacggaccggacaggactccgacctgccgttacggtggaactagtcgtacgtacgttaccgaacccaaaacgtattagttacgttaccgtttaagtttaccgggtaacccaggaacgaaacgggaaccgggccccggggaacccgtccgggtccccggtttgggttcgggtttaggttacggtaatttaacggtaaacgtaaaccggacgtaaccggaacgggtaccggtacccggtaccccgtaggaaccggtacccgttaccgtcggacgttaccgtacgtttaccgtcggttcgacccgtacggtaacggtaacggaccggtaacgtacccgtactaaacggttacggtaccggactacgtacggacggggttacggtaccgtaccggacgggaagaacggggtacggtaacgggtaccgggtacttaacggtttaaactttaacggtttatacggtttaaacctaacgtaacccgacgtaaaccctaacggttaacctttaggtttaaccggtttagtttacgtaccggtttaaccgttacggtaccgtacgaacccgggtaacgtaccccggtaccggttaccgggttcccgggtacgacccgaaacccggtacccgtacccgaaacccctcccgtatcccggtaccc

SEQ ID NO: 61149 - DNA, 805 bp, Homo sapiens
  misc_feature: GYAE6OF01CR4V7.52.42.D09.1.454.CMB.1.raw
tcagcgcagtacgacacgaccggtgctcgatttagacacatacgcagggaaagggggctgtgggtccaggaggcagaactctgggtgtctcaccatggcctggactccctctacttcctccccctcctcactctctgcacaggctcgtgacggcctcctatgacgctgaccacgacgcccacccgtggtcgtaccgacggttccgacccccgaaggaccgacggaccggccgaggactccaccgtcgcctcgtaggatatcgactagttccgaaccaaaccgtatacgtcgtacttacgttacggtaaccacgacgaacggaaccggcccggaccgaccggtcccgttggttaggttcggtagtaagtagtaaactaaacgtacgacgtaggaccggtaccgtacccgtacggacggtacctccggtagaccgtcttacgttcgtacgtcgaccgtcgacgggtacgacggacgtacgtcgtaacgagttcgactacgtcgtaggttcgacgtaccgaggtagaacgggaacggacgtacggtaccttaagtacgtttaagtttcgtaaccgtaactaacgtaccgtaaacgtaaccgtaaccgtaaccgttttaccggtttagtaaccttttaccggtttaccgtaacccgggtttaaacccggaacttacccgggtaacccggtaacccggttaaccgggttacccccgttaccccggttagggtaccccggtaaccccgtaccccggaacccgttaaacccgggaccccctttaacccggttacgtcccggtttaaaccccg

SEQ ID NO: 61150 - DNA, 893 bp, Homo sapiens
  misc_feature: GYAE6OF01C3T9T.52.42.D09.1.454.CMB.1.raw
tcagcgcagtacgacacgaccggtgctcgatttagacacatacgcagggaaagggggctgtgggtccaggaggcagaactctgggtgtctcaccatggcctggactccctctacttcctccccctcctcactctctgacacacggctctggacggtccttcctatggaacgctagaaccacaccgaccctaccccgttgggttcgtaccgacggttcccgacccccgaggaaccaacggacccggaccgtaagtacctaccgtacccgtcgccgttacggtaggacgtatcgtacgtaacgttaccgaaacccgtaaaacgtattaacgttcgttacgttttacggttaccggaacctacggaaccgaacggaaacccggggccccggtacccgtacccggtccccggtttggttacgggtttagggtaacgtaagtttaagaaacggaaacgtaaccgaggttaacgggacggaaccggttcccgaacgggtacgtaccgtccgtggtaactcgttacgttcgtacggtccgtaccgtcggtaacggacggtaacccggagttaaccgactaagttaccggtacggtacctaacgcgggtaaccggtacggttaccgaacggacgggacggtaacgggaacgggtacggaccgttaagtacgttaacgtacgttttagtaccgtaacttaaacgactaaaaccgaccgttaactacgtttaacgtttaaccgtttacgttaaccgttaccggttaccgtaacggttaaaccggtacccgtaacggaacccggttaacccggtacccggttacccggaacccgggttcgtacccggaaaccccttaacccggaaaccccgtacccccaaaccgttccgttaaccgtaaccccg

SEQ ID NO: 61151 - DNA, 696 bp, Homo sapiens
  misc_feature: GYAE6OF01BEZ95.52.42.D09.1.454.CMB.1.raw
  modified_base (184)..(184): a, c, t, g, unknown or other
  misc_feature (184)..(184): n is a, c, g, or t
tcagcgcagtacgacacgaccggtgctcgatttagacacatacgcagggaaagggggctgtgggtccaggaggcagaactctgggtgtctcaccatggcctggatccctctacttctccccctctcactctctgcacaggctctgacggcctccttatgagctgacacgagccacccgtcggtntcagtcgtaccccaggacacggaccgccgaggactccaccgtgcctgtggatatgctagttacggaccaaacgtatagtgtacgtttattcggtacctaggactaggaacggtcccggggaccgtaccggtccccttggttaggtttcggtagtacgttaggtaaactaaaggacctaacgtggaacgaccggtaccctacggtaggtaccttacccgacggaagtccgtacttccgtacgtaccggtcctacggacggttacgacgggtaccacggtacaccgtagttccggactagaccgtaggtacggacgtcgacggacgacggtaggacggtacgcgtcgtaacttagttcgtatacaactcacacgactcgttaagttcgttaattcgtacgtttcgaaccggtacgtaccgtacggtaaccgtcggttacccaccgggttcctacggggtaccaacccgggtaccccgaacgggtaccccctacccgttcggtacccgttacccg

SEQ ID NO: 61152 - DNA, 511 bp, Homo sapiens
  misc_feature: GYAE6OF02G4SZF.52.42.D09.1.454.CMB.1.raw
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
tcagcgcagtacgacacgaccggtgctcgatttagacacatacgcagggaaagggggacgtgtgggtccgaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattgcccaaaacgatatgcttatggtaccagcagaagcggccaggcccctgtgttggtgatcgtataaaagacactgagaggcctcagggatcccngagcgattctntggctccaggtcagggacaaacgggtnacattcggccatcagtggagtcagcagaggacgagctgacttatatgtcaagtcaacagacaccattagtacttatgtcttggaacttgcgactaaggtccacgtacccgtggtacacgcccaaggccaacccccagttcgtaccg

SEQ ID NO: 61153 - DNA, 566 bp, Homo sapiens
  misc_feature: GYAE6OF02H3J65.52.42.D09.1.454.CMB.1.raw
  modified_base (241)..(241): a, c, t, g, unknown or other
  misc_feature (241)..(241): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcaggggtcctcgagcgattctctggcgtcctacggtcgtacgggacgaacggtacgacgacttcggtccgactacgacgtagggacgtccgtacggacgagagggacgaggcgtgacgtattattgttcgaatacaacaagacaccacttaggttacttattgtactttcggtaacgtgtcgaccgaacggtcgaccgtccgtcgggttcgtacgacccgaacggacccgaaccccaacctcggtactaccg

SEQ ID NO: 61154 - DNA, 501 bp, Homo sapiens
  misc_feature: GYAE6OF02HYO21.52.42.D09.1.454.CMB.1.raw
  modified_base (241)..(241): a, c, t, g, unknown or other
  misc_feature (241)..(241): n is a, c, g, or t
  modified_base (494)..(494): a, c, t, g, unknown or other
  misc_feature (494)..(494): n is a, c, g, or t
tcagcgcagtacgacacgaccggtgctcgatttagacacatacgcagggaaagggggctgtgggtccaggaggcagaactctgggtgtctcaccatggcctggatccctctacttctccccctctcactctctgcacaggctctgaggcctcctatgagctgacacagccaccctcggtgtcagtgtccccaggacagacggccaggatcacctgctctggagatgcattgccaaaaccgntatgcttattgtaccagcagaagccgggccaggcccctgtgttggtgatgtaataaagacactgagaggccctgagggatccctgagcgattctctggctccgaggtcagggacaacggtcacattcggccatcgagtggagtccgaggcagaggacgagctgactattatgtacaatcaacagacactattgtacttatgtcttcgaactgacgaccgaagtccacgtctggcacgcccaaggcccaacccnctgtacc

SEQ ID NO: 61155 - DNA, 566 bp, Homo sapiens
  misc_feature: GYAE6OF02H3WPT.52.42.D09.1.454.CMB.1.raw
  modified_base (224)..(224): a, c, t, g, unknown or other
  misc_feature (224)..(224): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggngatgcattcgccaaaccgatatgcttattggtaccagcagaagccgggccaggcccctgtgttggtgatgtaataaagacactggaggacggccctcgagggtactcccgtagagtcgtattctctggctccgaggtcgagggacaacggtcacagttcggcctatcaggtggacgtccgaggcaaggacggacggaggcgtagtaacttagttattgtacaatacgaacaacgacacctaagttaggttactttagtgttacttacggactggccgtaacgtaacggtccaccggtccgtcggtaccacggacccgaaccggacccaacccctctgtaccc

SEQ ID NO: 61156 - DNA, 524 bp, Homo sapiens
  misc_feature: GYAE6OF02HPFAF.52.42.D09.1.454.CMB.1.raw
  modified_base (315)..(315): a, c, t, g, unknown or other
  misc_feature (315)..(315): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatcccgtgacgcgattctctggctcaggtcagggacaacggtcacattggccatcagtggagtccaggcagaggacgaggctgactattatgtacaatacaacagacaccagttagtacttagtacgtcttacgaactgacgtaccgtaacggtccaccgtccgtcgggtacacggcccaacggcccaaccccgtcgtcgtaccc

SEQ ID NO: 61157 - DNA, 639 bp, Homo sapiens
  misc_feature: GYAE6OF02J2QTP.52.42.D09.1.454.CMB.1.raw
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
tcagcgcagtacgacacgaccggtgctcgatttagacacatacgcagggaaagggggcgtgtgggtccgaggaggcagaactctgggtgtctcaccatggcctggatccctctacttctcccctcctcactctctgcacaggctctgaggcctcctatgagctgacacacgcccacccgtcggtgtcagtcgtccccaggaccaggaccggccaggactccacctgctcgtggagatgcattcgaccaaaaccgtntatcgtcttattcggtaccagcaggaacgccggccacggcccctgtgttggngatagtaactaaagcagtgagcggaccctacgagggtctcccgtggacgtcgtacttcgtcgtcggtcctacgaggtcacgggactacggtcacngtttcgactacgcgtaggtcgacgtcgtaggaccgaggacgggacgacggtctacgtacttattacttcgactaacgtacaactagacctaacgtagtttacgtaactttgttacgtacgtttaccgaacgttcgaccggttaaacccgtacggttacccgtacccgttacggttccggggtaacccaccgggtaccccgaaccggtaccccaaccccgttacgtccgttaacccg

SEQ ID NO: 61158 - DNA, 536 bp, Homo sapiens
  misc_feature: GYAE6OF02HW5PK.52.42.D09.1.454.CMB.1.raw
tcagcgcagtacgacacgaccggtgctcgatttagacacatacgcagggaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgtggtgatgtataaagacactgagaggccctgagggatccctgacgcgattctctggctccgaggtcagggacaacggtcacattggccatcagtggagtccgaggcagaggacgaggctgactattattgtacaatcaacagacaccagttgtactttatgttacttcggaacttcggacgtaaccaagggttaccacccggttcccgttagggtccacggacccgaaaccggaccccaaccccaccgtgtaccc

SEQ ID NO: 61159 - DNA, 541 bp, Homo sapiens
  misc_feature: GYAE6OF02G7BJV.52.42.D09.1.454.CMB.1.raw
  modified_base (241)..(241): a, c, t, g, unknown or other
  misc_feature (241)..(241): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaacgntatgcttattggtaccagcagaagccgggccaggcccctgtgttggtgatgtaataaagacactgagaggccctgaggatccctgagcgattctcgtggctcaggtcagggacaacggtcacattggccatcagtggacgtccaggcaggaggacgaggcttgactattagttgtacaattcaacagaacaccatttggtaacttagtacgttcttacggaactcgacgaaccgtaagggtccacccggttccgtacgggtccacggacccgaacggaccccaaacccctcgtcgtaccc

SEQ ID NO: 61160 - DNA, 533 bp, Homo sapiens
  misc_feature: GYAE6OF02I48KP.52.42.D09.1.454.CMB.1.raw
  modified_base (284)..(284): a, c, t, g, unknown or other
  misc_feature (284)..(284): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggccctgtgttgngatgtataaagcactgagacgccctgagggactcccgtgacgcgtattctcgtggctcgaggtcagggactaacggtcacgtatcggacagtcagtcggagtccaggcaggaggacgagctagacttagtattgtacaatcaacagacacctagttacgtacttatgtacttacgactgacgtaccgaaggtccaccggttccgtggtacgaccgacccgtaacggacccaaccccgtacgtcgtaccc

SEQ ID NO: 61161 - DNA, 570 bp, Homo sapiens
  misc_feature: GYAE6OF02H71LJ.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagcccgggcaggcccctgtgttggtgatgtataagacactgagacggccctcgagggactcccgtagacgcgtaattcgtctggtcctccgaggttcaaggggaaccaacgggtcactacgttcgggacctatccaggtggacgtccaggcacggaggacgaggctgacttattagttgtactaatcaaacgagaccaactacgttaggtactttagtcgttacttacggaactcgacgaccgtaacggtccaccggttccgtagggtcacggtcccgaacggacccaacccctacgtacgtacccg

SEQ ID NO: 61162 - DNA, 522 bp, Homo sapiens
  misc_feature: GYAE6OF02FXG84.52.42.D09.1.454.CMB.1.raw
  modified_base (243)..(243): a, c, t, g, unknown or other
  misc_feature (243)..(243): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgntatgcttattggtaccagcagaagccgggccaggcccctgtgttggtgatgtataaagacactgagaggccctcgagggactccctgacgcgattctctggctccaggtcagggacaacggtcacattggaccatcagtgagtcaggcaggaggacgaggctgacttattattgtacaatcaaacagaccacctattggtacttatgttcttcggactgacgacgaaggtccaccgtccgtggtaccacggacccaacggccctaaccccgctgtaccc

SEQ ID NO: 61163 - DNA, 747 bp, Homo sapiens
  misc_feature: GYAE6OF02J2JXL.52.42.D09.1.454.CMB.1.raw
  modified_base (276)..(276): a, c, t, g, unknown or other
  misc_feature (276)..(276): n is a, c, g, or t
  modified_base (368)..(368): a, c, t, g, unknown or other
  misc_feature (368)..(368): n is a, c, g, or t
tcagcgcagtacgacacgaccggtgctcgatttagacacatacgcagggaaaggggcgtgtgggtccaggaggcagaactctgggtgtctcaccatggcctggatccctctacttctcccctcctcactctctgcacaggctctgaggcctcctatgagctgacacacgcccaccctcggtgtcacggtgtcccccgaggaccaggaccgggtccaagggtactcaaccctggccttccgtagggagattgacctattttcggaccaaaaacccgnttaatcggtactttaactttcggttaaccgagccaacggaaacggcccgggaccacgggtcccccttggtcgtttcgggtgaactggttaanaaacggtacacgttggaacgacggacccgtacgaaggggtactacccgtggaacgcgtacttcgtctacggccttaccgagggttcccaaggggacctaaccggtcgacaagtttcggccatcgtagtggtacgtaccggaggtacgacggtaacgggacgacgggcttacgggaactttagttacgtttcgtacaacggttaccaaacgtacgaaccgtaacgttagttaaccgtttaacgtttacttacggttccgtttaaccggtaagttacggtaccgtaacccgtaaacggtcccgaaccggttccggttacgggacccgttaacggtaccccgaaaccgggttaccccaaacccggtacccgttcgtaacccg

SEQ ID NO: 61164 - DNA, 600 bp, Homo sapiens
  misc_feature: GYAE6OF02JAY62.52.42.D09.1.454.CMB.1.raw
  modified_base (418)..(418): a, c, t, g, unknown or other
  misc_feature (418)..(418): n is a, c, g, or t
tcagcgcagtacgacacgaccggtgctcgatttagacacatacgcagggaaagggggcgtgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgagatgcattcgccaaaaccgatatgcttattgtaccagcagaacgccgggccacggcccctgtcgtggtgatgtataaagacactggacgaggccctcgagggataccctgacgcgtattctctggctccgaggtcgagggacaacggtcacgattcggcatcagtggagtccgaggcaggaggacgaggctgactnttagttacgtactaatacgaacaacgtacaacctatttacggtaactttagtacgttacgtttacggaacttcggtaccgtaacccggtaaggttacccgttacccggtacccgttacggggtaccctaacgggtaccccgtaaaccgggacccctaaacccccggtacgtaccgttacccg

SEQ ID NO: 61165 - DNA, 552 bp, Homo sapiens
  misc_feature: GYAE6OF02G1SFU.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgcattgccaaaccgatatgcttattggtaccagcagaagccgggccaggcccctgtcgttggtgatgtataaagacactgagacggccctacgagggactcccgtgagcgtattctcgtggcctcgtaggtcgagggacaacggtcaacgtagttcggactatcaggtgacgtccaggcgaggaggacgaggtctagacttattagttagtacaatcaacacgaacactagttcgtattatcgtcgttacgactcgacgtaacaaggtacctaccggtccgtaggtaccacggtaccccgaagaccccgtaacccctcgtccgtacc

SEQ ID NO: 61166 - DNA, 653 bp, Homo sapiens
  misc_feature: GYAE6OF02JD24W.52.42.D09.1.454.CMB.1.raw
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
tcagcgcagtacgacacgaccggtgctcgatttagacacatacgcagggaaagggggcgtgtgggtccgaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattcggacccaaaaccgatatgctttagttggtaccagcagaacgcccgggacacggcccctgtgttggngatgtaataagacacgtgacgacggccctnagggactcccgtagagcgtattcctntcggacctccgaggtacgagggaacctaacgggtcaacgtagttcggacttatcgtaggtcggaacggtccagggcgaaggtacgggacggaggtcgtaagtacgttatttagttgtaacgacttacgaaacgacgtaacaccttaagttacggttaaactttagtcgtttacgttacgaaaccgttcggtaaccgaacccgtaaacgggttccctaaccggttcccggtacgggttaaccacccgggtaccccgaaaccggtacccccgaaaccccctacggttcttaaaccccg

SEQ ID NO: 61167 - DNA, 553 bp, Homo sapiens
  misc_feature: GYAE6OF02GSZ5L.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccaggcccctgtgttggtgatgtataaagacactgagacggccctcgagggactcccgtgagcgattctctggctccgagtcagggacacggtcacattcggccatcgagtggagtccgaggcaggaggacgaggctgacttattatgtacaatcaacagacactagttgtactttagtcgttacgttacgaacttggaccgtacgtaacgggttccaaccggttccgtacgggttaccacggtaccccgaaacggaccccaaccccgtactcggtaaccc

SEQ ID NO: 61168 - DNA, 650 bp, Homo sapiens
  misc_feature: GYAE6OF02H2WE8.52.42.D09.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (343)..(343): a, c, t, g, unknown or other
  misc_feature (343)..(343): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctcgtgganatgcattcgaccaaaacgntatgtaccttagttcggtaccagacagaacgccggccacggccctggtgttggtgattgtaataaagactactggagacggccctgagggacttcccgngacgcgtattctcgtggtctccgaggtcacgggtacaacgggtacaacgtagtttacggcctagttacgaggttacgggaacgtccgaagggaccaaggggacgggaacgtaacggtacgttacggtaaccttaagtttacgtttgaacgtaaactacgaaaccgaagacctaaccgtaattacgttaaacttgtacggttaccgttaacggaacctcgtaccgtaaccgtaacggtacctacccggttaccgtcgggtcgaaccggaccccgtaacggacccccaaaccccgttcgtacgtaaccc

SEQ ID NO: 61169 - DNA, 565 bp, Homo sapiens
  misc_feature: GYAE6OF02FTQZK.52.42.D09.1.454.CMB.1.raw
  modified_base (201)..(201): a, c, t, g, unknown or other
  misc_feature (201)..(201): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagcgcagtacgacacgaccggtgctcgatttagacacatacgcagggaaagggggacgtgtgggtccgaggaggcagaactctgggtgtctcaccatggcctggatccctctacttctcccctcctcactctctgcacaggctctgaggcctcctatgagctgacacagccaccctcggtgtcagtgtcccccaggacngacggccaggatcaccctgcctctggagatgcattgccaaaccgatatgcttatggtaccagctagaagccgggccaggccccctaggtcgttggtcgatgtataaagacactgagaggccctcagggatccctgagcgaattctctggctcccaggtcaggggacaaacgggtcaacgtatggccactacgagtggacgtccgaggcgaaggnggaacgnggactgacttatagttagtcaagttcaaacagacgacccatttcgggtacttaatgtacttcggtaacttgacgaccgtaacggtcgtacccgtcctacgggtcaacggccctaaacggaccctaacccccgacctgtacccg

SEQ ID NO: 61170 - DNA, 523 bp, Homo sapiens
  misc_feature: GYAE6OF02GN8KH.52.42.D09.1.454.CMB.1.raw
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccaggcccctgtgttggtgatgtaataaagacactgagaggccctgagggactcccgtgacgcgtattctctggctccgaggtcagggacaacggtcacattggccatcagtggagtccgaggcaggaggacgnggctggacttagttatgtacaatcaaanagaccactagttgtacttatgtacttcggaactgacgaacgaaggtccaccgtcctggacacgccaacggccccaacccgtctcgtacc

SEQ ID NO: 61171 - DNA, 678 bp, Homo sapiens
  misc_feature: GYAE6OF02HPYXO.52.42.D09.1.454.CMB.1.raw
  modified_base (365)..(365): a, c, t, g, unknown or other
  misc_feature (365)..(365): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctcctatgagctgacacagccacctcggtgtcagtcgtcccaggacagacgccgaggatcacctgctctggagatgcattcgaccaaaccgtatatcgtacttagttcgtaccagacaaggaacggcccgggtaccacgggtcccctggttcggttggtatacgtaggtaataaacggctacgtagacggtacgcccgtacgtaagggcttaccgnggacgacgtacttctcgtggctcgaggtcgacggtactaacggtcactagttcggacctagtcgaggttcgggaacgtccgaaggaccgaggtacgggacggacgtaccgttaggtaaaccttagtttaagttcggtaactaaacttcgaaaccgaacggtaccctaaccgtaagttttacggttaacctttggttacgtccgtttaccgggaagtttaccgaccggtaacgaacggttacccgaccggttccggtaacgggttcaacccggtacccgaaacgtacccccgtaacctacggttacgtaccccg

SEQ ID NO: 61172 - DNA, 656 bp, Homo sapiens
  misc_feature: GYAE6OF02JYHAF.52.42.D09.1.454.CMB.1.raw
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcgacctgctctaggagatgcattgaccaaacgatatgcttatggtacagtcagaagccgggccaggcccctgtgttcggtgacttgtaataaaggactacgtaggacggtacggtccctacggacgggtacctaccgtggaacgacgttaacgttccgtacggtcggtcctaccggtacgggtaccgtaacgggaaccgtaaccgggttaccaacgttacggtacggtacctacgtacgtaggtacggtaacggtcgacggacgaggacggaacggacgngtacgacttagttntacgtacataacgaacacgactaacgtagttacgttaacttagtacgtacgtttaccgaacgttcggtaacgtaaccgtaacgggtacctacggtccggttacggtaccgtaccgtaaccgaaaccggccctaacccgtataccggttaccc

SEQ ID NO: 61173 - DNA, 620 bp, Homo sapiens
  misc_feature: GYAE6OF02IUMSQ.52.42.D09.1.454.CMB.1.raw
  modified_base (312)..(312): a, c, t, g, unknown or other
  misc_feature (312)..(312): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgcctcgtggagatgctattcgaccaaaccgatatgctttagttcggtaccagcaagaacgccgggaccacggcccctggtcgttggtgatgtaanaaagcacgtgagacggccctagaggtactcctggagacgtacttctcgtacggctaccgaggtcgaacgggacgaacggtcacgtagtcgacctagtcaggtggacgtcgaggcaggacggacgacggtctaggtaactttagttagttacgtacctaagtaccaaacgtacgaactaaccgtagtttacgttaactttagtcgtacgttaccgaacgtcgaaccgtaaccgtaacggtccgtaaccggttccggtaggtacccgaccgacccggaaaccgtaccccaaaccccgtcgtacgtacccg

SEQ ID NO: 61174 - DNA, 660 bp, Homo sapiens
  misc_feature: GYAE6OF02F2PRL.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgctattcgacccaaaaccgatatgtcttattacggtaccagcaagaacggccggaccacggcccctgtgttggtgatgtaataaagactacgtaggagacggtcccgtacgagggtacctcccgtaggacggcgtaatttccgtacgtcggtcctaccgaggttccgaaaggggtaccaacgggtaccacgtaagttcggacctagtcgaggtaggacgtaccgagggtacaagggacgggaaccggaggcgttagactttaagttacttacggtactaacgtacaaaccgagacctaacgtagtttacggttacttaatcggtttactacgggtactcgtaccgaacggtaacgtccgtaaccggttcccggtacgggtaccaaccgggaccctaaaccgggacccctaaacccgtacgtcccgtaaccg

SEQ ID NO: 61175 - DNA, 645 bp, Homo sapiens
  misc_feature: GYAE6OF02H6ZOZ.52.42.D09.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctgganatgcattgaccaaaaccgntatgcttattggtaccagcagaacgccggccacggcccctgtgttcggtgatgtaagtaaacgacacgtagaggacggtaccctacgacgggactccccgtgacggcgtacgttctctacggcctccgaggtcgaagggaccgtaaccgggtcacgtagttcggacctagtaccgtaggtacggtacgtaccgaacggtcgaagggacgggaccggaggtctagaacttaattacgttgtactaagtaccaaactacgaaccacgtaagtttcgttaacgtttatcgttacgttacggtaactcggtaccgtaaccgtaacggtcccaacccggttccgtacgggttaccaacggaccccgtaacggaacccccgaaccccgtaccgttcgtaaccccg

SEQ ID NO: 61176 - DNA, 791 bp, Homo sapiens
  misc_feature: GYAE6OF02JHIZV.52.42.D09.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgagcctcctatgagctgacacagccaccctcggtgtcagtcgtccccaggacagacggccaggatccaccgtgctactgganatgccattcgaccaaacgntatgcttatcggtaccagcagaacgccgggacacggcccctggtcgttaggtgactagtaactaaacgaccgtactggacgtacggccctagacgggtactcccgtagagccgtaattccgtacgtcggtccgttaccgacgggttccaacggggaaccctaaccgggttcaaacggtacgtttacgggaccctaagttaccgacgggttaggtacccgttaccggaacgggtaccgtaaacgggtaccggggtaaacggacggtaaccggttacggtttaacccgtttaagttttaaacggtttaccgttaaccgttaaaccgtaacgttaaaccggaaccgtaaaccgtaacccggtttaattttaccggggtttaaacttttaaccggtacgggttttaacccgtttaacgggggtaaaccctttcggaaaccccggttaaccggtaagggttaccctaacccgggttacccggtacggttaccgaacccgtaaccggtaacccgtaaccccgaaacccccgttacgttacccggttaacccg

SEQ ID NO: 61177 - DNA, 810 bp, Homo sapiens
  misc_feature: GYAE6OF02IWCL7.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctcgtggagatcgctacgttcgacccaaaaccgatacgtgtactttagttcggtaccagacgaaggaaccggccccggggacctaccgggtccccgttggttcggtttggggtagtaacgttaggtaaacgtaaaacggacctacgttacggaacggaccggtaccccgttacggaacgggtacctcccgtaggaccgtacgttacttccgtaccgtcggtaccttaccggaggtaccggaacgggtaaccgtaccggtaccaacgtacgttaccggacctacgttaccggacgggtacggaccggtaccggaacggacgaacgggacgggaaccggtacgggtaccgttaacgtacgttttaagtttagttacgttaacctaactaacgaaacctaaccgtaaccttaaccgttagtttaacggttaactttacggttaccggtttaccttaacgggtaaccgttacggacccggtaaacccggtaaccggtttacccgtaacccggtttcggtaccgggtaacccgtacccggtaaccccggaacccggtaaccccccaaccccggttaccgttacccgttaaccccg

SEQ ID NO: 61178 - DNA, 674 bp, Homo sapiens
  misc_feature: GYAE6OF02FTUH2.52.42.D09.1.454.CMB.1.raw
  modified_base (253)..(253): a, c, t, g, unknown or other
  misc_feature (253)..(253): n is a, c, g, or t
tcagcgcagtacgacacgaccggtgctcgatttagacacatacgcagggaaagggggctgtgggtccaggaggcagaactctgggtgtctcgaccatggcctggatccctctacttctccccctctcactctctgcacaggctctgaggcctcctatgagctgacacagccaccctcggtgtcagtcgtccccgaggacagacggccaggactccaccgtgcctcgtggagatgctagttcgacccaaaccgnttatgacttagttcggtaccagacagaacgcccgggaccacggccccgtggtcggttggtcgtagtagtaagtaaacgacacgtaggacggaacggccctacgacgggtaactcccgtaggacggtcgtacttcgtccgtcggtcctccggtaaggtaccgaacggggaacctaaccggggttcctaacgtacgtttacggacctagtaccgtaggtcggacgtccgaaggcgagacggacgaggctagattacttgttagtacagtacaacacgacaccgtattacggttacttaacgttcgttacgttacgtaccttacggaccggtaaccgtaacgggttcccgtaacccggttccgttacggttaccgaccggtacccgtaaaccggacccccgaaccctaccgtacgttaaccccg

SEQ ID NO: 61179 - DNA, 749 bp, Homo sapiens
  misc_feature: GYAE6OF02FGRFV.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttcctccccctcctcactctctgcacaggctctgacggcctcctatgagctgacacagcccacccgtcggtgtcagtcgtccccgaggacaggacggccaggactcacctgctcgtggagatcgactagttcgaacccaaaccgtagtactcggtacttagttcggtaccagacgtaaggaacggcccgggacccgaccgggtcccccgttggttcggttgggtacgtagtaggttaaataaacgtacacgtaggacggacggtccctcggaacgggtacctccgtaggacggtactacgttccgtcgtcggacctacggtacggtacggaacgggtaaccgtaacggtcacgtacgtcggactacgtacgaggtcggtacgtaccgtaggcggaacggtacgggaacgaggtaccgtagtaaccttttagttacgttacgtactaacgtaaccgaacgtaacggtacctaacgttaggtttaccggtttaacgttacgtttcggttaaccgttacgggtaaccttaccgggaaccggtaacccggtaaccgggtaccctacccgggttccggttaccgggtaccgtaccggaaccccgtaacccggaccccctaacccgagttacccgtaacccg

SEQ ID NO: 61180 - DNA, 616 bp, Homo sapiens
  misc_feature: GYAE6OF02GXSAT.52.42.D09.1.454.CMB.1.raw
  modified_base (199)..(199): a, c, t, g, unknown or other
  misc_feature (199)..(199): n is a, c, g, or t
  modified_base (341)..(341): a, c, t, g, unknown or other
  misc_feature (341)..(341): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctcctatgagctgacacagcccaccctcggtgtcagtcgtccccaggacngacggccaggatcaccctgcctctggagatgcattcgacccaaacgatatgccttattgtaccagcgagaacggccgggcctacggcccccttgtcggttggtcggtatggtaataaagacactagagacggccctgacggntccctagcgcgtacgttcgtctcggtctcccggacggtacggaacgggaccgaacggttccaacgttagtcggccatcgtaagtggtacgtaccgaggcgaaggacgggacggacggcgtagtaccgttaagttcttagtaccaatacgaaccaagtaccacgttattacggtacttaacgtgttaccttacgacgttgtaccaacggtaacgtaccgtacccgtccgtaggtaccgacggtacccgacggaccccgaaccctacgtcctaaccg

SEQ ID NO: 61181 - DNA, 619 bp, Homo sapiens
  misc_feature: GYAE6OF02IJ1EX.52.42.D09.1.454.CMB.1.raw
  modified_base (168)..(168): a, c, t, g, unknown or other
  misc_feature (168)..(168): n is a, c, g, or t
  modified_base (433)..(433): a, c, t, g, unknown or other
  misc_feature (433)..(433): n is a, c, g, or t
tcagcgcagtacgacacgaccggtgctcgatttagacacatacgcagggaaagggggctgtgggtccaggaggcagaactctgggtgtctcaccatggcctggatccctctacttctccccctctcactctctgcacaggctctgacggcctcctatgagctgacacngacccacctggtgtcagtcgtacccaggacagacgccaggatccactgcttcgtggatatgctagttcgaccaaacgatatgtcttattcggtaacagacaaggacgccggcacggccccttgtcgttgggcagttgtaactaagacacgtgaggaccgtcctgaggtactccgtgacgcgtactcgtcgtcgtactacgaggtacgacgggtaacgaacgtcaacgtactttcgacctaaggtcctaggtcggtaccgtaccgnggtaaccgaggacgggacgaggtacgtacgtaaacttgtttaacgtacgtacctaagaccaacaagacctacttagttacgttactagttcgtttacgttaggacctcgacgtaaccgaagttccgaccgttacggtcgtaccggacgtaccccggaaccgtaccccaaccctacgtaccgtaccg

SEQ ID NO: 61182 - DNA, 712 bp, Homo sapiens
  misc_feature: GYAE6OF02HIW1O.52.42.D09.1.454.CMB.1.raw
  modified_base (111)..(111): a, c, t, g, unknown or other
  misc_feature (111)..(111): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
tcagcgcagtacgacacgaccggtgctcgatttagacacatacgcagggaaagggggctgtgggtccaggaggcagaactctgggtgtctcgaccatggcctggatccctntacttctcccctctcactctctgcacacggctactgacggcctacctatcgagcctgacacagccaccctggtgtcagtcgtcccaggacagcgcaggatcactgctntggantgcattcgaccaacgtatactgtacttagttcggtaacctacgacgtaacggaacggcccggcccgaacgggtcccccttaggttaggtttagggtgtaacgttacgtaaataaacgtacgtacgtacggaaggttaaccggcccctacggtaacgggtaccttcccggtagtacgggtacgttacgttccgtacggttcggtcctaacggtacgggttacgaaacggggtaacccgtaaacggtcgtaacgtacggtttacgggacctacgtacgaacggttacgggacgtaccgaggtaccgaggtaacgggaccgaaggtctacggtaacttagttacttaggtaactacgtacaactaacgactaaccttagttacgtactttaacgttcgtacgttcgtaacgttacgaccgtaaaccggtacgtcctaccgtaaccggtacggactccggaaccaaccggtacccacccgtactcgtaaccc

SEQ ID NO: 61183 - DNA, 768 bp, Homo sapiens
  misc_feature: GYAE6OF02I1UNB.52.42.D09.1.454.CMB.1.raw
  modified_base (187)..(187): a, c, t, g, unknown or other
  misc_feature (187)..(187): n is a, c, g, or t
tcagcgcagtacgacacgaccggtgctcgatttagacacatacgcagggaaagggggctgtgggtccaggaggcagaactctgggtgtctcaccatggcctggactccctctacttctccccctcctcactctctgcacaggctctgagcctctatgagctgacacgacgcccacccgtcggtgtcncggtcgtccccgaggacacggaccggccaaggtactacccaccgttcggccttacgttagggaacgtacgttcgacgttattcggaaccctaaaccggtattacgttgtaccttttaacggttacggtaacccgaggtaccgaaggtaaccgggacccgggtacccgaccgggtcccccgttgggttccgggttaggttacggtagttaagggttaaacgtaaacggtacctacggttaggaacggtaccggtaccctaggtacgggccttaccgtcggtaggtacgtcttacgtcgtcggtccctaggtacggtacgaacggaacgtaacgtacgacgtagtccgtactacgtacggtaggtcgttaaccggacgacggtacggtaacgggacgtacggaccgggtagttaacgacttttagttacttaacgtacttaacgacgtaacgacgtaaccgtacttaaggttcttaagttcgttaccgacgtttacgacgtaccgaggtacccgtaacggtcctaccggtaccgttacggacgacccgtacgacccggtaccccgaacttccggtagttaccc

SEQ ID NO: 61184 - DNA, 920 bp, Homo sapiens
  misc_feature: GYAE6OF02H30RQ.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctcccctcctcactctctgcacagctctgaggcctcctatgagctgacacacgcccacccgtcggtgtcagtcgtccccaggacacggaccggaccgaggactccgacctggcctcgtaggagtactgacagttcgaccaaaccgtatacgtcgtacgtttagttacggtaaccgaggacgtaacggaaccgggcccgggacccggtaccgggtaccccggttcggttcgggttcggttaggtaacgttacggtaaaagtaaacggaccgtaacgtaggaacggtaccggaccccgtacggtaacgggtacttcccggtaggtacggtaccgttacttttccgtacgtcggtacccgtacggtacggtacggtaccggggtaaccgtaaaccgggtacgaaccgttaaggtttaccgggaccctaagttaccggtaacgggttaccgggtaaccggttacccggaaagggtacgggtaacggggtaaacgggaccggtaacgggtaccgttaacgttaacgtttaaggtttaacgtttacggtaacctaaacggttaccaaaaccgggttaccgaaaccgtaaccggtttaaacggtttaaccggttttaaaccgtttaacggtttaccggttaaaccggtttacccggggtaaaacttccggggaaacccgtttaaaccgggacccgggttaacccgttaacccgggtttaacccggttaacccggggtaccggttaaccccggaaccccgggtaacccggtaaacccccggaaacccttacccggtaccggtttaacccccgg

SEQ ID NO: 61185 - DNA, 648 bp, Homo sapiens
  misc_feature: GYAE6OF02G0E7G.52.42.D09.1.454.CMB.1.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (536)..(536): a, c, t, g, unknown or other
  misc_feature (536)..(536): n is a, c, g, or t
  modified_base (578)..(578): a, c, t, g, unknown or other
  misc_feature (578)..(578): n is a, c, g, or t
  modified_base (612)..(612): a, c, t, g, unknown or other
  misc_feature (612)..(612): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgaggcctcctatgagctgacacagccctaccctcggtgtcgagtcgtcccccaggacaggacggccaggactcactcgctctcggagatgctattgaccctaaaaccgatanctactttaattcggaacacgngaagaacgccggccgacggtcccctgtcgttaggtgatagtaagtaaaagctaagtgaacgacgccctacgagggcctaccggtagacgtacgtacttacgtcgtcggcgttccgacggtacgacggggaactaacgggtactaacgttacgtcggtaccgacttacgaagggttcgaaccggtaccgacggtacgaacgggtaccgggagtacgggaccgtttcgaaacgtttatacggttagttaccaacttacganaaccggtactaacctagttagtcctaatcggtattaacgganctaacggaactacgggtactcccgttagaccggntacccgactaccggaaccctacctacgtccgttaac

SEQ ID NO: 61186 - DNA, 747 bp, Homo sapiens
  misc_feature: GYAE6OF02FU95V.52.42.D09.1.454.CMB.1.raw
  modified_base (250)..(250): a, c, t, g, unknown or other
  misc_feature (250)..(250): n is a, c, g, or t
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggacgatgctattcgacccgaaaaccgntatcgtcttaacgttaggtaccagacaacgaacggcccgggaccacggtcccccgttggttcggttgggtacgtagtaggtaaagtaaacggaacgtacgtacggacgacgggtaccctcggaacgggaccttccgngtacggcgtacttcgtctggtccncgtacggtcgaacgggtaacaacgggtaccacgtacgttacggaccgattcgaggtacggacggttaccgaggcgaaggacgggtaccgaggtccgtaagtacttaagtttagttacgttacaaccgttaacaaacctaacggtaaccaaccgtttaaacggttacggtttaacgttacgttcggttaaccgtttaacggaccgttacggaacccggttacccgggtaaaggttaccccgttaacccgggtttcccgggtaaccgggtttcccgaacccggtaccccggtaaacccggtacccccgtaaaccctacccggttaccgttaacccccg

SEQ ID NO: 61187 - DNA, 725 bp, Homo sapiens
  misc_feature: GYAE6OF02HQI8J.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctctggagatgcattcgaccaaaaccgatatgtcttagttggtaccagacaagaacggcccgggtccacggtccccttggtgttgggtgtatggtaacgtaaagaccaactggagacggtcctagacgggactcccgtggacgtcgtattcgtcgtcggcttccgaggtcgagggaactaacggtcaactagttcggacctagaccgtaggtcgggtagtaccggaggacgtaaaggacgggaaccggagggtaccttacgggtaaaccttttaagttttaacgttacggtaccttaaaacgtccgaaaaaccgtacgtaaaccctaaccgttaaggtttaacggttaaccttttaaggtacgtttaccggttttaacgggaaccttcgggtaaccgtaaaccccggtaacgggttcccctaacccgggttacccgttacgggttaacccgaacccggtaccccggaaaccgtaacccccggtaaccccttacggttccccgtaacccg

SEQ ID NO: 61188 - DNA, 877 bp, Homo sapiens
  misc_feature: GYAE6OF02HEZW8.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctcgtagacggcctccgtatcgagcgtgaccacgacgcccacccgtcggtgtccgacgtccgtccccaagggacgacggaccggaccgacggactaccgaccgttcgtccgtaccgtagggacgtagtcggtaccttaggtttaccgaaacccgtaaaaccggtcttaagttacggttacttttaaccggttaccggtaaccgtaacgtacgaccgggtaaaccgggccccggggtaccggtacccgggttaccccgttaagggttcggggttttacggtaaggtaaccggttagtttaaaaccggaaaacggtaccgtaaccggttagggaccggtaacccgggttcccgtacgggtaaaccgggttaccgttacccgtagggtaccggtaccgttacgttccgtcggtccggtaaccgtacccgtaggggtaaccgaacgggtaccgtaaaccgtcgtaacgtaaccggtcgaccctaggtccgtaacggtaccgggtactaccggaggacgtaaacgggcggtaccggaggtcgacgttaaccgttagttacgtactaacgtaacgtaacgtaacgaaccttaaccggatttacggttaacgttacgttaagttcccgtaacgtttacgacgttaccgtaccggtaactcggtacccgttaccgggtacgttacccgggacttaccccggaaccgggaccttaacccccggtaccaccgtttacccgtacccgg

SEQ ID NO: 61189 - DNA, 677 bp, Homo sapiens
  misc_feature: GYAE6OF02I6A8U.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctccccctcctcactctctagcacaggctctgaggcctcctatgagctgacacagccaccctcggtgtcagtgtcccccaggacagaccggccaggactcaccttgctctggagatgctattcgacccaaaccgatatcgtactttagttcggtaccagcgagaacggtcccgggacctaacggtcccccgttaggttcggtttgggtacgagttaggttaacgtaaaggacctaacgttagacggtaacgggtcccttacgagggtaccttcccgtaggacgtacgtattcgtcgtcggtcctccgtaggtcgtacgggaacgtaaccggtcaaccgtacgtttcgaccgtacgttacgacggtagggtaccgtccgagggtacgacgggacgggacgagggtacgttacggtacttagttagttcgtaacctaacgtacaaccgtaacaccgtactacgttacgttacttatcgttcgtacgtactcgacggtaacctacggtacctaccggtcgtcggtacgaccgtcccgaaccggcccaaccccgtgtaccgtaccc

SEQ ID NO: 61190 - DNA, 836 bp, Homo sapiens
  misc_feature: GYAE6OF02GDEAZ.52.42.D09.1.454.CMB.1.raw
tcagcgcagtacgacacgaccggtgctcgatttagacacatacgcagggaaaggggctgtgggtccaggaggcagaactctgggtgtctcaccatggcctggatccctctacttctcccctctcactctctgcacaggctctgacggcctctatgacgctgacacagcccacccgtggtcgtcaggttccgtaccccgaggacgaggacccggccaagggtactcccgtaacccgtgtaccttacggtagggaacgtacgtcggtaccttaacgttaccggaaaccccaaaaccggtattacggttacgtacgtttaacgttacgggtaacccgtagaccgtaaacggaaaccggtccccggggacccgtaaccgggtccccccgtttaggttacggtttaggggtacggtaacgttacggttaaacgttaaaacggtaccgtaaccggtttaggaaccggtacggtaccccgttacggaacggggtacttacccgtaggacgtccgtacgtttccgcgttcggcctccggtaacggttaccggaacgggtaaccgtaacgggttaccaaccgttacgttcgtaccgtaagtacggtacggttacggtaacgtaccggaggtaccgagggtacggtacgacggtacgttacggtaactttagttacgttacgtaataaccgtacaaacgtacgtaaccgtacgttacgtttacggttaactttacggtcgttacgttaacggtactacgggtaccgtaccgtaacggttaccgtaccgttacggtccgtaacggccgacccggtaccgaaccccgtaacccgtcgtacgttacccg

SEQ ID NO: 61191 - DNA, 765 bp, Homo sapiens
  misc_feature: GYAE6OF02IDFPB.52.42.D09.1.454.CMB.1.raw
tcagcgcagtacgacacgaccggtgctcgatttagacacatacgcagggaaagggggctgtgggtccaggaggcagaactctgggtgtctcaccatggcctggatccctctacttctcccctcctcactctctgcacaggctctgacggcctcctatgagctgacacacgcccacccgtcggtgtcagtcgtaccccgaggacacggacggaccgaggactccacctggacctcgtaggacgatcgacgtattccggaaccaaaaccgattagtcgtacgtttaagttacggtaacctagacgaacggtaaccgggccgggacccgtccggtaccccgttggttggttacggtagaagttacgtaaagtaaacgaccgtacgtacggaacggtaccggtccccgtaaggacgggtactcccggtaggacgtaccgttacttccggtcgtaccggtcctaccggagggtaccgaacgggtaaccgacgtacctacggtacgtcggactagtacgtaggtacggtacgacggtaggaacgagggacggacggcgtacgtacgttaactttaagtttacgttacgtaactaacgaacgtaaccgacgtaaccgaacgtttagttaaccggttaacttacggttacggttaccgttaaccgtaacgtaccggtaaccgtaaccggtaaccggtacccggtaccggtaccggttaccgtaccgaccggtaccccgaaccggtacccctaaacccgtccgtaccgtacccg

SEQ ID NO: 61192 - DNA, 715 bp, Homo sapiens
  misc_feature: GYAE6OF02GRKEU.52.42.D09.1.454.CMB.1.raw
  modified_base (249)..(249): a, c, t, g, unknown or other
  misc_feature (249)..(249): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactactctgcacaggctctgaggcctcctatgagctgacacagcccaccctcggtgtcagtcgtcccccaggacagacggccaggatcacctgctcgtggagatgcattcgaccaaaaccgntatgcttattggtaccagcagaagccggcagcccctgtgtggtgatgtataagacactagagacgccctgagggtactcccgtgacgcgtacttctcgtcggctccgaggtccgaacgggaccgtaacggtccaacgtacgtttcggaccctagtcgtaacggtcgggtaacgtcccgaagggtccgaaagggtacgggaaccggtacgggccttacggtaacgtttaagtttaagtttacggtaactaaacgtaccgaaacgtaacgtaaccctaaccgtagttttaacgttaaccttttaacggttaccggtttaaccgtttacgggaacccgtttacgggaacccgttaaccggtaaacgggttaccccgtaaccccggtttacccgggttcgggtaacccgtaacccgggtaccccggaaaccgggtccccccgaaaccccgttccgtacgttaacccccgg

SEQ ID NO: 61193 - DNA, 743 bp, Homo sapiens
  misc_feature: GYAE6OF02GR1HP.52.42.D09.1.454.CMB.1.raw
  modified_base (256)..(256): a, c, t, g, unknown or other
  misc_feature (256)..(256): n is a, c, g, or t
  modified_base (581)..(581): a, c, t, g, unknown or other
  misc_feature (581)..(581): n is a, c, g, or t
tcagcgcagtacgacacgaccggtgctcgatttagacacatacgcagggaaagggggctgtgggtccaggaggcagaactctgggtgtctcaccatggcctggatccctctacttctcccctcctcactctctgcacagctcgtgggcctcctatgaactgacacacgcctaccctcggtagtcacgtcgtcctcgaggacagacggccaggactcacctgctcgtggacgatcgactagttcgaaccgaaaccgngtagtctacgtttaagtcggtaacctagactaacggtaacggcccggtaccgaacggtccccgtggtcgttacggtgacgttagtaaacgtaacgacacgtagacggtaaccggtccgtacggacggccttaccggacggtagaccgttacttccgtcgtacggtcctacggtacggtaccgaacgggtaccgtaaacggtaccaaggttacgtacgggtacctaacgtacggttacggtcggtaacggtacccgtagggacgtaacgggacgggtaacggtaaggtcgtaaggttaaacttaggtttaacgtacctaacgtaanaaaccgtaacgaactaaccgtacttaagttacggttaactttaagtcgtaccggttacggactaaccgtacggtaccgaacggttaccctacccggtttacgaccgggttacacccggtacccggaaacgtccccgaaccgtacgtaccgtaccctacccgg

SEQ ID NO: 61194 - DNA, 965 bp, Homo sapiens
  misc_feature: GYAE6OF02H4L9P.52.42.D09.1.454.CMB.1.raw
tcagcgcagtacgacacgaccggtgctcgatttagacacatacgcagggaaagggggctgtgggtccaggaggcagaactctgggtgtctcaccatggcctggactccctctacttctccccctctcactctctgcacaggctcgtggacggccttcctagtgacgtcgtacgaaccacgaccgaccccgtacccgttcgggttcgttacgaacggtttccgtacccccgaagggaaccgtacggacccggaccgaagggtactacccgtaaccttcggtccgttacggtacgggacgtaagttacggaccttacgttacccgaaacccgtaaaaaccggtatttaacgtccgtttacgttttaaacggtttacggtaaccggtacggaccgtaaacggtaccgggaccccggtaccggtaacccgggtccccgttaggtttcggttagggtacgttaacggtttacggtaaacgttaaaacggacccgttaacgttacggggaacgtaccggttacccccgagggtaaccggttccgttacccgaggacggtaccgttattcccgtacggtcccgtcgtaaccgggtaggtcccggtaaacgggtaaccgaaccggggttaccaaccgttacgggtttaccggacctttaaccgtacgtaagggtaccggtccggttaacccgggaggtaacggaacgggaaacgggtacgggtaacgggttaccgttaacggtttaactttacggttttcgtaaccgtttaagaaccgtaaaccgtaactaacgtaaacccgtcggtttaaacgtttacggttaaccttttaacggtcttttaaacccggttacggtaaccgtcccgtaacggtaacccggtaaacgttcccggttaacccgtcgggttacccggacgtaacccggaaccccggaaccttaacccccggaaccccttacgttacccgggtacc

SEQ ID NO: 61195 - DNA, 830 bp, Homo sapiens
  misc_feature: GYAE6OF02GL6AK.52.42.D09.1.454.CMB.1.raw
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgacggccctcctatgagctgacacacgcccaccctcggtgtccagtcgtaccccaggacagaccggccaggactcacctgactcgnggagatcgctaagtttcgtaccaaaaccggnttagtacgtacttaacgttcggtaaccacgtacgacggtaacggccccgggaccacggtcccccgtaggttggttcggtagtacgtagtaacgtaaacgactaacgtacgacggaccggaccccgtacggacgggtaccttaccccgtaggtaccggtacggtaacttccgttacggtcggtacccgtccggtacggtaccggtaacggggaaccgtaaccgggtaccacgttacggttacccggacgtacgttacggtacggttacgggtaccggttaccggacggtacggaaggtaccgggaaccggtacgggtacgttacggtaacctttaagttttacgttaacgtttaccgaaacgttaccgtaaaacggtacccggtaaacccgtaacgttaacgggttttaccggttaaacctttacggtttacgttaacccgttacgggtaaacccgtcggtaaccggttaaccggtaaccggttacccgtaccccggttacggtaccggtacccgaccggtaccccgtaaccgggaccccctaaaccccgtccgtaccgttaaccccgg

SEQ ID NO: 61196 - DNA, 635 bp, Homo sapiens
  misc_feature: GYAE6OF02FT7JE.52.42.D09.1.454.CMB.1.raw
  modified_base (313)..(313): a, c, t, g, unknown or other
  misc_feature (313)..(313): n is a, c, g, or t
tcagcgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctctatgagctgacacagccaccctcggtgtccagtgtccccaggacagacggccaggatcacctgctctggagatgcattgaccaaaaccggatatgcttattggtaccagcagaagccggccaggccccctgtgttggtcgatgtagtaaagacacttagngaacggccctcgagggactccctgagcgattccgtctggaccttccgacgggttcgaaggggaccaaacgggtcaactacgttggacccatcgagttcgggacgttccgaggtaccagggaacgggacgaggaccgtagtaccttaattacgttagtacctaaagttaccaaacgtacgaaacctaacctaagtttacgggttaacttaatcggtttactaccgtaacgttcgacgaacccgtaaacgggtcctaaccgggtcccttagggtccgtacggtacccctaaacggaccccgtaaccccctagtaccgttacccg

SEQ ID NO: 61197 - DNA, 709 bp, Homo sapiens
  misc_feature: GYAE6OF02FVOPL.52.42.D09.1.454.CMB.1.raw
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (223)..(223): a, c, t, g, unknown or other
  misc_feature (223)..(223): n is a, c, g, or t
  modified_base (698)..(698): a, c, t, g, unknown or other
  misc_feature (698)..(698): n is a, c, g, or t
tcagcgcagtacgacacgaccggtgctcgatttagacacatacgcagggaaagggggctgtgggtccaggaggcagaactctgggtgtctcaccagtggcctggactccctctacttcctcccctctcactctctgcacgagctctgcggcctctatggacgctagacncagccctacctggngtcagtcgtaccagcacgacggcagactcacgtgctacgnggagtatgctagtcaaccaacgtattacgtacgttacgtttacgttacggtaacccgagtacgtaacgggaaccggcccggttaccgaccggtccgttggttacggtgggttacgtacgtacgggtaactaaacgacacgttaggaaccggtacgacccgttacggaggtccgttaccgtacggtcgtaccgttacgttcgtacgtacgggtacctccggtaacgggtaccgaggaacccttaacggtcaagttacgtacgcctagtaccgtaggtacgacgtacggacgtacggtacggaacggtaccgtacgggtacgtacgtacgttaacgttgtacttacgtaagactaacgactacgtacgttagtacttacgttcgtacgtaggttaccgtacgtacggtacctaacggtaccgtaccttccgggacgtaggtccggtaaccgcccggtaacccgaccgtaccgttacncccggtaaccg

SEQ ID NO: 61198 - DNA, 933 bp, Homo sapiens
  misc_feature: GYAE6OF02IK2HH.52.42.D09.1.454.CMB.1.raw
  modified_base (139)..(139): a, c, t, g, unknown or other
  misc_feature (139)..(139): n is a, c, g, or t
tcagcgcagtacgacacgaccggtgctcgatttagacacatacgcagggaaagggggctgtgggtccaggaggcagaactctgggtgtctcaccatggcctggactccctctacttcctccccctctcactctctgcanaggctctggaggtccctcctagtgacgctagacctacacgcccacccgttcggtgtccgagtccgtcccgaaggtacgaacggaccggccgaggtactccgacctgtacctcgtaggaagacgtgactagttccgaacctaaccgtatacgtcgtacgtttagttacggaccgagtacaacggaacggtccggaccgtaaccggtccccgttaggttcggttacggtgttaacgttacggttaaacgaaaacgtaccgtacgttaggaaccggtaccggtacccgtacggtaaacgggtccccttaccggtacggtaacggtaccgttacgtttaccgtaccgttacgggtcccgttaaaccgggtaccgggttaaccgggtaaaccgggggtaaaaccgttaacccgggttaaccgtaaccggtttacgtttcccggggtaaaccttaacggttaccgggtaaaccggttacggggttaacccggttaacccgggtaaggggaaaccggaaaggggtaaacccggggaacgggttacggtaaaccggtttaaggtttaaacgtttaacgtttaaacgtttaaccgtaaaccgttaacgttaaacccgtaaaccggtaacgtaaacccgttacccgttaacggtttaaccgtttaaacgtttaacggttaaccgtttaccgttaacgttaaccgtaccggtaacgtaaccggtaaccgttacccgtaccgttaccggtacgtaacccgaccggtaaccgaacccgaacccgtaaacccgtccgttacgtacccg

SEQ ID NO: 61199 - DNA, 364 bp, Homo sapiens
  misc_feature: GYAE6OF01CUIX5.34.75.G09.1.454.CMB.1.raw
  modified_base (345)..(364): a, c, t, g, unknown or other
  misc_feature (345)..(364): n is a, c, g, or t
tcagtacacgtgatcacgaccggtgctcgatttagtatagacatcagggactacttagcttggttccagcagaaccaggacagcctcctaagttgctcattcctggcatctaccggaatccgggtcctgaccgattcagtggcagcgggtctgggacagatttcactctcaccatcaccagcctgcagcctgaagatgtggcagtttatactgtcagcaatattatagtcctcgctcactttcggcggaggaccaaggtgagatcaaacgactgtggctgcaccatctgtcttcatcttccgcatctgaatcacgtgtactgagcgggctggcaaggcgcatagnnnnnnnnnnnnnnnnnnnn

SEQ ID NO: 61200 - DNA, 360 bp, Homo sapiens
  misc_feature: GYAE6OF01BW071.34.75.G09.1.454.CMB.1.raw
  modified_base (353)..(360): a, c, t, g, unknown or other
  misc_feature (353)..(360): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcgagggaccaaggtgagatcaaacgactgtggctgcaccatctgtcttcatcttccgcatctgaatcacgtgtactgagcgggctggcaaggcgcatagnnnnnnnn

SEQ ID NO: 61201 - DNA, 363 bp, Homo sapiens
  misc_feature: GYAE6OF01DDMQY.34.75.G09.1.454.CMB.1.raw
  modified_base (359)..(363): a, c, t, g, unknown or other
  misc_feature (359)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcacttttcggcggaggaccaaggtggagatcaaacgaactgtggctgcaccatctgtcttcatcttcccgccatctgaatcacgtgtactgagcgggctggcaaaggcgcatagnnnnn

SEQ ID NO: 61202 - DNA, 359 bp, Homo sapiens
  misc_feature: GYAE6OF01D08W5.34.75.G09.1.454.CMB.1.raw
  modified_base (291)..(291): a, c, t, g, unknown or other
  misc_feature (291)..(291): n is a, c, g, or t
  modified_base (351)..(359): a, c, t, g, unknown or other
  misc_feature (351)..(359): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcggaggaccaaggtgagatcaaacgactgtgctgcacntctgtcttcatctcccgcatctgaatcacgtgtactgagcgggctggcaaggcgcatagnnnnnnnnn

SEQ ID NO: 61203 - DNA, 361 bp, Homo sapiens
  misc_feature: GYAE6OF01ALJVL.34.75.G09.1.454.CMB.1.raw
  modified_base (233)..(233): a, c, t, g, unknown or other
  misc_feature (233)..(233): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (354)..(361): a, c, t, g, unknown or other
  misc_feature (354)..(361): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccgggtccctgaccgattcagtggcagcgggtctgggacagatttcactctcaccatcaccagcctgcagcctgaggatgtggcagtttattactgtcagcaatattanagtcctccgctcactttcggcgagggaccaaggtgagatcaaacgaactgtggctgcaccatctgtcttcatcttcccgcatctgaatcacgtntactgagcggntggcaaggcgcatagnnnnnnnn

SEQ ID NO: 61204 - DNA, 371 bp, Homo sapiens
  misc_feature: GYAE6OF01B398Z.34.75.G09.1.454.CMB.1.raw
  modified_base (357)..(357): a, c, t, g, unknown or other
  misc_feature (357)..(357): n is a, c, g, or t
  modified_base (363)..(371): a, c, t, g, unknown or other
  misc_feature (363)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagacttcactctcaccatcagcagacttgagcctgaagattttgcagtttattactgtcagcagtataataactggcctccggggacgttcggccaagggaccaaggtggaattcaaaacgaactgtggctgcaccatctgtcttcatcttcccgccatctgaatcacgtgtactgagcgggctggcaaggcncatagnnnnnnnnn

SEQ ID NO: 61205 - DNA, 362 bp, Homo sapiens
  misc_feature: GYAE6OF01BJFRS.34.75.G09.1.454.CMB.1.raw
  modified_base (353)..(362): a, c, t, g, unknown or other
  misc_feature (353)..(362): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcggaggaccaaggtggagatacaaacgactgtggctgcacatctgtctcatcctccgcatctgaatcacgtgtactgagcgggctggcaaggcacatagnnnnnnnnnn

SEQ ID NO: 61206 - DNA, 362 bp, Homo sapiens
  misc_feature: GYAE6OF01EZUL8.34.75.G09.1.454.CMB.1.raw
  modified_base (358)..(362): a, c, t, g, unknown or other
  misc_feature (358)..(362): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcggctggcaaggcgcatagnnnnn

SEQ ID NO: 61207 - DNA, 365 bp, Homo sapiens
  misc_feature: GYAE6OF01DDS6M.34.75.G09.1.454.CMB.1.raw
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (323)..(323): a, c, t, g, unknown or other
  misc_feature (323)..(323): n is a, c, g, or t
  modified_base (350)..(365): a, c, t, g, unknown or other
  misc_feature (350)..(365): n is a, c, g, or t
tcagtacacgtgatcacgaccggtgctcgatttagtatagacatcagggactacttagcttggttccagcagaaaccaggacagcctcctaagttgctcatttcctggacatctacccgggaatccggggtccctgaccgattcagtggcagcgggtctgggacagatttcactctcaccatcaccagcctgcagcctgaagntgtggcagtttatacngtcagcaatatatagtcctcgctcactttcggcgaggaccaaggtgagatcaaacgactgtggctgcaccatctgtcttcatcttcccgcatctgaatcacgtntactgagcggctggcaaggcgcatagnnnnnnnnnnnnnnnn

SEQ ID NO: 61208 - DNA, 366 bp, Homo sapiens
  misc_feature: GYAE6OF01DP668.34.75.G09.1.454.CMB.1.raw
  modified_base (358)..(366): a, c, t, g, unknown or other
  misc_feature (358)..(366): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaacgaactgtggctgcaccatctgtcttcatcttcccgccatctgaatcacgtgtactgagcgggctggcaaggcgcatagnnnnnnnnn

SEQ ID NO: 61209 - DNA, 389 bp, Homo sapiens
  misc_feature: GYAE6OF01CP0XS.34.75.G09.1.454.CMB.1.raw
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
  modified_base (361)..(389): a, c, t, g, unknown or other
  misc_feature (361)..(389): n is a, c, g, or t
tcagtacacgtgatcacgaccggtgctcgatttagtatagacatcaggggactacttaagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttatactgtcagcaaatattatagtcctcgntcactttggcgtaggaccaaggtgagatcaaaacgactgtggctgcaccatctgtcttcattctccgcatcctagaatcacgtntactgacgcgggctggacaaggcgacatagnnnnnnnnnnnnnnnnnnnnnnnnnnnnn

SEQ ID NO: 61210 - DNA, 364 bp, Homo sapiens
  misc_feature: GYAE6OF01BNKV0.34.75.G09.1.454.CMB.1.raw
  modified_base (359)..(364): a, c, t, g, unknown or other
  misc_feature (359)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggagggaccaaggtggagatcaaacgaactgtggctgcaccatctgtcttcatcttcccgccatctgaatcacgtgtactgagcgggctggcaaggcgcatagnnnnnn

SEQ ID NO: 61211 - DNA, 360 bp, Homo sapiens
  misc_feature: GYAE6OF01ETDA5.34.75.G09.1.454.CMB.1.raw
  modified_base (354)..(360): a, c, t, g, unknown or other
  misc_feature (354)..(360): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggagggaccaaggtggagatcaaacgaactgtggctgcacatctgtctcatctccgcatctgaatcacgtgtactgagcgggctggcaaggcgcatagnnnnnnn

SEQ ID NO: 61212 - DNA, 371 bp, Homo sapiens
  misc_feature: GYAE6OF01A5UNB.34.75.G09.1.454.CMB.1.raw
  modified_base (328)..(328): a, c, t, g, unknown or other
  misc_feature (328)..(328): n is a, c, g, or t
  modified_base (356)..(371): a, c, t, g, unknown or other
  misc_feature (356)..(371): n is a, c, g, or t
tcagtacacgtgatcacgaccggtgctcgatttagtatagacatcagggactacgttagcttggttccagcagaaaccaggacagcctcctaagttgctcatttcctgggcatctacccgggaatccgggtccctgaccgattcagtggcagcgggtctgggacagattttcactctcaccatcaccagcctgcagcctgaagatgtggcagtttattactgtcagcaatattatagtcctcgctcacttttcggcggaggaccaaggtggagatcaaacgactgtggctgcacatctgtcttcatcttcccgcatctgaatcacgtntactgagcgggctggcaaggcacatagnnnnnnnnnnnnnnnn

SEQ ID NO: 61213 - DNA, 362 bp, Homo sapiens
  misc_feature: GYAE6OF01DP0KI.34.75.G09.1.454.CMB.1.raw
  modified_base (355)..(362): a, c, t, g, unknown or other
  misc_feature (355)..(362): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaacgactgtggctgcaccatctgtctcatccttccgcatctgaatcacgtgtactgagcgggctggcaaggcgcatagnnnnnnnn

SEQ ID NO: 61214 - DNA, 360 bp, Homo sapiens
  misc_feature: GYAE6OF01DJP95.34.75.G09.1.454.CMB.1.raw
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (354)..(360): a, c, t, g, unknown or other
  misc_feature (354)..(360): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagtgggtctgggacagatttcactctcaccatcaccagcctgcagcctgaagatgtggcagtttatactgtcagcaatattatagtcctcgctcactttcggcggagggaccaaggtggagatcaaaacgactgtggctgcaccatctgtctcatccttccgcatctgaatcacgtntactgagcgggntggcaaggcncatgnnnnnnn

SEQ ID NO: 61215 - DNA, 354 bp, Homo sapiens
  misc_feature: GYAE6OF01D5GF5.34.75.G09.1.454.CMB.1.raw
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (348)..(354): a, c, t, g, unknown or other
  misc_feature (348)..(354): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtggagatcaaacgactgtggctgcacatctgtctcatctccgcatctgaatcacgtntactgagcggctggcaaggcnatgnnnnnnn

SEQ ID NO: 61216 - DNA, 365 bp, Homo sapiens
  misc_feature: GYAE6OF01B0J2U.34.75.G09.1.454.CMB.1.raw
  modified_base (358)..(365): a, c, t, g, unknown or other
  misc_feature (358)..(365): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnnnnnn

SEQ ID NO: 61217 - DNA, 360 bp, Homo sapiens
  misc_feature: GYAE6OF01DSULE.34.75.G09.1.454.CMB.1.raw
  modified_base (354)..(360): a, c, t, g, unknown or other
  misc_feature (354)..(360): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtgagatcaaacgaactgtggctgcaccatctgtcttcatcttccgcatctgaatcacgtgtactgagcgggctggcaaggcgcatagnnnnnnn

SEQ ID NO: 61218 - DNA, 364 bp, Homo sapiens
  misc_feature: GYAE6OF01DUQY9.34.75.G09.1.454.CMB.1.raw
  modified_base (328)..(328): a, c, t, g, unknown or other
  misc_feature (328)..(328): n is a, c, g, or t
  modified_base (356)..(364): a, c, t, g, unknown or other
  misc_feature (356)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaacgaactgtggctgcaccatctgtcttcatcttcccgcatctgatcacgtntactgagcggctggcaaggcgcagtagnnnnnnnnn

SEQ ID NO: 61219 - DNA, 362 bp, Homo sapiens
  misc_feature: GYAE6OF01E063N.34.75.G09.1.454.CMB.1.raw
  modified_base (351)..(351): a, c, t, g, unknown or other
  misc_feature (351)..(351): n is a, c, g, or t
  modified_base (357)..(362): a, c, t, g, unknown or other
  misc_feature (357)..(362): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcgagggaccaaggtggagatcaaacgaactgtggctgcaccatctgtcttcatcttcccgccatctgaatcacgtgtactgagcgggctggcaaggcncatagnnnnnn

SEQ ID NO: 61220 - DNA, 365 bp, Homo sapiens
  misc_feature: GYAE6OF01DBCYX.34.75.G09.1.454.CMB.1.raw
  modified_base (359)..(365): a, c, t, g, unknown or other
  misc_feature (359)..(365): n is a, c, g, or t
tcagtacacgtgatcacgaccggtgctcgatttagtatagacatcagggactacttagcttggttccagcagaaaccaggacagcctcctaagttgttcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcaactttcggcggagggaccaaggtggagatcaaacgaactgtggctgcaccatctgtcttcatcttcccgcatctgaatcacgtgtactgagcgggctggcaaggcgcatagnnnnnnn

SEQ ID NO: 61221 - DNA, 369 bp, Homo sapiens
  misc_feature: GYAE6OF01BIQZJ.34.75.G09.1.454.CMB.1.raw
  modified_base (357)..(360): a, c, t, g, unknown or other
  misc_feature (357)..(360): n is a, c, g, or t
  modified_base (362)..(369): a, c, t, g, unknown or other
  misc_feature (362)..(369): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccgggtccctgaccgattcagtggcagcgggtctgggacagatttcactctcaccatcaccagcctgcagcctgaagatgtggcaggtttatactgtcagcaagtattatagtcctccgctcactttcggcggagggaccaaggtggagatcaaacgactgtggctgcaccatctgtcttcatcttcccgcatctgaatcacgtgtactgagcgggctggcaaggcgcatagnnnngnnnnnnnn

SEQ ID NO: 61222 - DNA, 357 bp, Homo sapiens
  misc_feature: GYAE6OF01EPUPB.34.75.G09.1.454.CMB.1.raw
  modified_base (350)..(357): a, c, t, g, unknown or other
  misc_feature (350)..(357): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctcgctcactttcggcgaggaccaaggtgagatcaaacgactgtggctgcaccatctgtctcatctcccgcatctgaatcacgtgtactgagcgggctggcaaggcgcatagnnnnnnnn

SEQ ID NO: 61223 - DNA, 364 bp, Homo sapiens
  misc_feature: GYAE6OF01BMKF3.34.75.G09.1.454.CMB.1.raw
  modified_base (359)..(364): a, c, t, g, unknown or other
  misc_feature (359)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcacttttcggcggagggaccaaggtggagatcaaacgaactgtggctgcaccatctgtcttcatcttccgccatctgaatcacgtgtactgagcgggctggcaaggcgcatagnnnnnn

SEQ ID NO: 61224 - DNA, 369 bp, Homo sapiens
  misc_feature: GYAE6OF01CO8VA.34.75.G09.1.454.CMB.1.raw
  modified_base (345)..(345): a, c, t, g, unknown or other
  misc_feature (345)..(345): n is a, c, g, or t
  modified_base (351)..(369): a, c, t, g, unknown or other
  misc_feature (351)..(369): n is a, c, g, or t
tcagtacacgtgatcacgaccggtgctcgatttagtatagacatcagggactacttagcttcggttccagcagaaaccaggacagcctcctaagttgctcatttcctgggcatcctacccgggaatccggggtccctgaccgattcagtggcagcgggtctgggacagatttcactactcaccatccaccagcctgcagcctgaagatgtgcagtttatactgtcagcaatatatagtcctccgctcacttcggcgaggaccaaggtgagatcaaacgactgtggctgcaccatctgtctcatctccgcatctgaatcacgtgtactgagcggctggacaaggcncatagnnnnnnnnnnnnnnnnnnn

SEQ ID NO: 61225 - DNA, 377 bp, Homo sapiens
  misc_feature: GYAE6OF01A3ATQ.34.75.G09.1.454.CMB.1.raw
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (355)..(377): a, c, t, g, unknown or other
  misc_feature (355)..(377): n is a, c, g, or t
tcagtacacgtgatcacgaccggtgctcgatttagtatagacatcagggacgtacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcgaggaccaaggtgagatcaaacgactgnggctgcaccatctgtcttcattcttcccgcatctgaatcacgtgtactgagcggctggcaaggcncatagnnnnnnnnnnnnnnnnnnnnnnn

SEQ ID NO: 61226 - DNA, 371 bp, Homo sapiens
  misc_feature: GYAE6OF01B4KXY.34.75.G09.1.454.CMB.1.raw
  modified_base (364)..(371): a, c, t, g, unknown or other
  misc_feature (364)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaaacgaactgtaggctgcacatctgtcttcatcttcccgctatctgaactcacgtgtactggagcgggctggacaaggcgacagtagnnnnnnnn

SEQ ID NO: 61227 - DNA, 432 bp, Homo sapiens
  misc_feature: GYAE6OF01C7LPW.34.75.G09.1.454.CMB.1.raw
  modified_base (204)..(204): a, c, t, g, unknown or other
  misc_feature (204)..(204): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (387)..(432): a, c, t, g, unknown or other
  misc_feature (387)..(432): n is a, c, g, or t
tcagtacacgtgatcacgaccggtgctcgatttagtatagacatcagggacgtacttagcttggttccagcagaaaccaggacagcctcctaagttgctcatttcctgggcatctacccgggaatccggggccctgaccgattcagtggcagcgggtcttgggacagatttcactctcaccatcaccagcctgcagcctgaagngtggtggctagtttatacgtgtcagctaattattatacgtcctcgcttctactttggcggaggaaccaaggtgganatacaaacgactgtggctgcaccatcngtcttcattccgttcccgcctaatacagaactcgacgttgtaacctgacggcgggactgggacaaaggtcgacagtaggnnnnnnnnnnnnnnnnnnnnnnnnnnnnnnnnnnnnnnnnnnnnnn

SEQ ID NO: 61228 - DNA, 363 bp, Homo sapiens
  misc_feature: GYAE6OF01A4HD1.34.75.G09.1.454.CMB.1.raw
  modified_base (356)..(363): a, c, t, g, unknown or other
  misc_feature (356)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcgagggaccaaggtggagatcaaacgaactgtggctgcaccatctgtcttcatcttcccgcatctgaatcacgtgtactgagcgggctggcaaggcgcatagnnnnnnnn

SEQ ID NO: 61229 - DNA, 361 bp, Homo sapiens
  misc_feature: GYAE6OF01B724N.34.75.G09.1.454.CMB.1.raw
  modified_base (352)..(359): a, c, t, g, unknown or other
  misc_feature (352)..(359): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctcgctcactttcggcggaggaccaaggtggagatcaaacgaactgtggctgcacatctgtctcatcttccgcatctgaatcacgtgtactgagcgggctggcaaggcgcatagnnnnnnnngg

SEQ ID NO: 61230 - DNA, 366 bp, Homo sapiens
  misc_feature: GYAE6OF01CMQPI.34.75.G09.1.454.CMB.1.raw
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (358)..(366): a, c, t, g, unknown or other
  misc_feature (358)..(366): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaaacgaactgtggctgcaccatctgtcttcatcttccgcatcngaatcacgtntactgagcgggctggcaaggcgcaatagnnnnnnnnn

SEQ ID NO: 61231 - DNA, 366 bp, Homo sapiens
  misc_feature: GYAE6OF01DG3GO.34.75.G09.1.454.CMB.1.raw
  modified_base (203)..(203): a, c, t, g, unknown or other
  misc_feature (203)..(203): n is a, c, g, or t
  modified_base (352)..(352): a, c, t, g, unknown or other
  misc_feature (352)..(352): n is a, c, g, or t
  modified_base (358)..(366): a, c, t, g, unknown or other
  misc_feature (358)..(366): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagntgtggcagtttatactgtcagcaatattatagtcctcgctcactttcggcggaggaccaaggtggagatcaaacgactgtggctgcaccatctgtcttcatccttcccgcatctagaactcacgtgtactgacgcgggctggcaaggcncatagnnnnnnnnn

SEQ ID NO: 61232 - DNA, 366 bp, Homo sapiens
  misc_feature: GYAE6OF01A8ZU7.34.75.G09.1.454.CMB.1.raw
  modified_base (358)..(366): a, c, t, g, unknown or other
  misc_feature (358)..(366): n is a, c, g, or t
tcagtacacgtgatcacgaccggtgctcgatttagtatagacatcagggactacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaaatcaaacgaactgtggctgcacatctgtcttcatcttcccgcatctgaatcacgtgtactgagcgggctggcaaggcgcatagnnnnnnnnn

SEQ ID NO: 61233 - DNA, 361 bp, Homo sapiens
  misc_feature: GYAE6OF01BEJWS.34.75.G09.1.454.CMB.1.raw
  modified_base (357)..(361): a, c, t, g, unknown or other
  misc_feature (357)..(361): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggagggaccaaggtggagatcaaacgactgtggctgcaccatctgtcttcatcttcccgcatctgaatcacgtgtactgagcgggctggcaaggcgcatagnnnnn

SEQ ID NO: 61234 - DNA, 363 bp, Homo sapiens
  misc_feature: GYAE6OF01AWXCR.34.75.G09.1.454.CMB.1.raw
  modified_base (359)..(363): a, c, t, g, unknown or other
  misc_feature (359)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcacttttcggcggagggaccaaggtggagatcaaacgaactgtggctgcaccatctgtcttcatcttcccgccatctgaatcacgtgtactgagcgggctggcaaggcgcatagnnnnn

SEQ ID NO: 61235 - DNA, 359 bp, Homo sapiens
  misc_feature: GYAE6OF01A97QR.34.75.G09.1.454.CMB.1.raw
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (352)..(359): a, c, t, g, unknown or other
  misc_feature (352)..(359): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcccgaagatgtggcagtttattactgtcagcaatattatagtcctccgctcactttcggcggaggaccaaggtggagatacaaacgactgtggctgcaccatctgtctcatctccgcatcngaatcacgtntacngagcggctggcaaggcgcatgnnnnnnnn

SEQ ID NO: 61236 - DNA, 373 bp, Homo sapiens
  misc_feature: GYAE6OF01BA01O.34.75.G09.1.454.CMB.1.raw
  modified_base (359)..(373): a, c, t, g, unknown or other
  misc_feature (359)..(373): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctggggacagatttcactctcaccatcaccagcctgcagcctgaagatgtggctagttttatactgtcagcaatattatagtcctccgctcactttcggcggagggaccaaggtgagatcaaaacgactgtgctgcaccatctgtcttcatctccgcatctagatcacgtagtactgagcgggctggacaaggcgacatagnnnnnnnnnnnnnnn

SEQ ID NO: 61237 - DNA, 371 bp, Homo sapiens
  misc_feature: GYAE6OF01BGCYB.34.75.G09.1.454.CMB.1.raw
  modified_base (355)..(355): a, c, t, g, unknown or other
  misc_feature (355)..(355): n is a, c, g, or t
  modified_base (360)..(371): a, c, t, g, unknown or other
  misc_feature (360)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttattactgtcagcaatattatagtcctccgctcacgtttcggcggtagggaccaaggtggagatacaaacgaactgtggctgcacatctgtctcatcctccgcatctagaatcacgtgtactgagcggtctggcaaggcgnatagnnnnnnnnnnnn

SEQ ID NO: 61238 - DNA, 372 bp, Homo sapiens
  misc_feature: GYAE6OF01ELECV.34.75.G09.1.454.CMB.1.raw
  modified_base (358)..(372): a, c, t, g, unknown or other
  misc_feature (358)..(372): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggagggaccaaggtggagatcaaacgactgtggctgcaccatcgtgtcttcactcttcccgcatctgaatcacgtgtactgacgcggctggcaaggcgcatagnnnnnnnnnnnnnnn

SEQ ID NO: 61239 - DNA, 362 bp, Homo sapiens
  misc_feature: GYAE6OF01A9A41.34.75.G09.1.454.CMB.1.raw
  modified_base (358)..(362): a, c, t, g, unknown or other
  misc_feature (358)..(362): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcacttttcggcggagggaccaaggtggagatcaaacgaactgtggctgcaccatctgtcttcatcttcccgcatctgaatcacgtgtactgagcgggctggcaaggcgcatagnnnnn

SEQ ID NO: 61240 - DNA, 371 bp, Homo sapiens
  misc_feature: GYAE6OF01EK2N3.34.75.G09.1.454.CMB.1.raw
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (359)..(371): a, c, t, g, unknown or other
  misc_feature (359)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttattactgtcagcaatattatagtcctccgntcacgtttcggcggaggaccaaggtggagatacaaacgtaactgtagctgcacatctgtctcatctccgcatctnatcagtgtactgagcggctggctaacggcgacagtacgnnnnnnnnnnnnn

SEQ ID NO: 61241 - DNA, 446 bp, Homo sapiens
  misc_feature: GYAE6OF01BP4HD.34.75.G09.1.454.CMB.1.raw
  modified_base (334)..(334): a, c, t, g, unknown or other
  misc_feature (334)..(334): n is a, c, g, or t
  modified_base (392)..(398): a, c, t, g, unknown or other
  misc_feature (392)..(398): n is a, c, g, or t
  modified_base (400)..(446): a, c, t, g, unknown or other
  misc_feature (400)..(446): n is a, c, g, or t
tcagtacacgtgatcacgaccggtgctcgattttagtatagacatcgtagggggactaacttagcttggttccagccagaaaccaggacagcctcctaacgttgctcatttcctgggcatctacccgggaatccggggtccctgaccgattcagtggcagcgggtctgggacagattttcactctcaccatcaccacgcctgcagccctggaaggatgtcggcctagttttattactgtcagcagtataatactggcctcggggacttcggctaagggacccaagggtggaattcaaaacgaatgtggctgcaccatctgtctcatctcccgcntctagaactcgacgtctacctgagtcggctgggcgtaaggggcacgtagtacgtatcnnnnnnncnnnnnnnnnnnnnnnnnnnnnnnnnnnnnnnnnnnnnnnnnnnnnnn

SEQ ID NO: 61242 - DNA, 378 bp, Homo sapiens
  misc_feature: GYAE6OF01A4344.34.75.G09.1.454.CMB.1.raw
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
  modified_base (277)..(277): a, c, t, g, unknown or other
  misc_feature (277)..(277): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (358)..(378): a, c, t, g, unknown or other
  misc_feature (358)..(378): n is a, c, g, or t
tcagtacacgtgatcacgaccggtgctcgatttagtatagacatcaggggactacttagcttggttccagcagaaaccaggaacagccctcctaagttgctcatttcctgggcatctacccgggaatccggggtccctgaccgattcagtggcagcgggtctgggacagatttcactctcacatcaccagcctgcagcctgaagntgtggacagtttactacgtgtcagcaatattatagtcctccgntcacgtttcggcggtaggaccaaggtganatcaaacgatgtggctgcaccatctgtcttcatccttccgcatctgaatcaagtgtacagagacggntgcaaggcnatagnnnnnnnnnnnnnnnnnnnnn

SEQ ID NO: 61243 - DNA, 708 bp, Homo sapiens
  misc_feature: GYAE6OF01BT0RF.34.75.G09.1.454.CMB.1.raw
  modified_base (186)..(186): a, c, t, g, unknown or other
  misc_feature (186)..(186): n is a, c, g, or t
  modified_base (240)..(240): a, c, t, g, unknown or other
  misc_feature (240)..(240): n is a, c, g, or t
  modified_base (532)..(532): a, c, t, g, unknown or other
  misc_feature (532)..(532): n is a, c, g, or t
tcagtacacgtgatcacgaccggtgctcgatttagtatagacatcagggactacttagcttggttccagcagaaaccaggacagcctcctaagttgctcatttcctgggcatctacccgggatccggggtcctgaccgattcagtggcagcgggtctgggacagtatttcactctcaccatcaccngcctgcagcctgaagatgtcggcagtttatactgtcagcaatattatacgtccncgctctacttcggcggagggacctaaggttggagtactaccgaaaacgtaacttggtacggccttacggacctaccgaagtttccgtcggttacctttaccacgtttaccccgtttccccggaccttagttccgttaacggtaaaaccggttccgtaacgggtttaacggttaaccggttacggtaaacggggtcccggggtaacccgttaaggggaccgtaaaacgggcccgggttaactaacgttacgggtactaacgccggtagtaactaggactacgttcggtaaccncgtacgtactacggtacaggtacgcgtaacgtcgttacgagtcgtacgtacgtacgtacgtacgtacgtacgtacgtacgtacgtacgtacgtacgtacgtacgtaacgtacgtacgtacgtacgtacgtacgtacgtacgtacgtacgtacgtacgtacgtacgtcgtacgtacg

SEQ ID NO: 61244 - DNA, 359 bp, Homo sapiens
  misc_feature: GYAE6OF01ASFQK.34.75.G09.1.454.CMB.1.raw
  modified_base (355)..(359): a, c, t, g, unknown or other
  misc_feature (355)..(359): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaacgactgtggctgcaccatctgtcttcatcttcccgcatctgaatcacgtgtactgagcgggctggcaggcgcatagnnnnn

SEQ ID NO: 61245 - DNA, 386 bp, Homo sapiens
  misc_feature: GYAE6OF01CXJ0I.34.75.G09.1.454.CMB.1.raw
  modified_base (204)..(204): a, c, t, g, unknown or other
  misc_feature (204)..(204): n is a, c, g, or t
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (373)..(375): a, c, t, g, unknown or other
  misc_feature (373)..(375): n is a, c, g, or t
  modified_base (377)..(386): a, c, t, g, unknown or other
  misc_feature (377)..(386): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaaagntgtggctagtttatactgtcagacaattattatagtccctcgctcacgtttcggcggacggaccaaggtgganatacaaacgactgngctgccacatctgtctcactcgttcccnctagtctagaactcacgtntaacgtgacgcgggtnaggcgaaggtcgcataggnnngnnnnnnnnnn

SEQ ID NO: 61246 - DNA, 363 bp, Homo sapiens
  misc_feature: GYAE6OF01CDS9B.34.75.G09.1.454.CMB.1.raw
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (354)..(363): a, c, t, g, unknown or other
  misc_feature (354)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttatactgtcagcaatattatacgtcctccgctctacgtttcggcggaggaccaaggtgagatcaaagactgtgctgcacntctgtcttcatctccgctatctgaactcacgtgtactgagcgggctggcaaggcncatgnnnnnnnnnn

SEQ ID NO: 61247 - DNA, 393 bp, Homo sapiens
  misc_feature: GYAE6OF01B2O7B.34.75.G09.1.454.CMB.1.raw
  modified_base (201)..(201): a, c, t, g, unknown or other
  misc_feature (201)..(201): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (378)..(380): a, c, t, g, unknown or other
  misc_feature (378)..(380): n is a, c, g, or t
  modified_base (382)..(393): a, c, t, g, unknown or other
  misc_feature (382)..(393): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtcctgaccgattcagtggcagcggtctgggacagatttcactctcaccatcaccagcctgcagcctgaagntgtgctagtttatactgtcagcaatattactacgtcctccgcttcacgtttcggcggacggaccgaaggtcggagactacaaacgaactcgtggctgcaccgacgtcctgtccttcgacttccttccgcctatctgaactcacgtntacgngacggcggtctggcaaggcacatagnnngnnnnnnnnnnnn

SEQ ID NO: 61248 - DNA, 370 bp, Homo sapiens
  misc_feature: GYAE6OF01E0R6P.34.75.G09.1.454.CMB.1.raw
  modified_base (361)..(370): a, c, t, g, unknown or other
  misc_feature (361)..(370): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagttttattactgtcagcaatattatacgtcctccgctcacgtttcggcggagggaccaaggtggagatacaaacgaactgtggctgcacatctgtctcatctcccgctatctagaactcacgtgtactgagcggctggcaaggcacatagnnnnnnnnnn

SEQ ID NO: 61249 - DNA, 367 bp, Homo sapiens
  misc_feature: GYAE6OF01B68CI.34.75.G09.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (355)..(367): a, c, t, g, unknown or other
  misc_feature (355)..(367): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcacgttcggcggagggaccaaggtgagatcaaaacgactgnggctgcacatctgtcttnacttctcccgcatctgaatcacgtgtactgagcgggctggcaaggcncatgnnnnnnnnnnnnn

SEQ ID NO: 61250 - DNA, 400 bp, Homo sapiens
  misc_feature: GYAE6OF01D60MQ.34.75.G09.1.454.CMB.1.raw
  modified_base (203)..(203): a, c, t, g, unknown or other
  misc_feature (203)..(203): n is a, c, g, or t
  modified_base (348)..(348): a, c, t, g, unknown or other
  misc_feature (348)..(348): n is a, c, g, or t
  modified_base (380)..(400): a, c, t, g, unknown or other
  misc_feature (380)..(400): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagntagtggctagtttatactgtcagcaattattatagtcctcgctctacgtttcggcggaggaccaagggtgagtactacaaacgagtgtggcctggccacgtatcttgttcttcactccttcccgctattcgagtactcacggttntacgtgacgcgggtctggacgaaggcataagnnnnnnnnnnnnnnnnnnnnn

SEQ ID NO: 61251 - DNA, 362 bp, Homo sapiens
  misc_feature: GYAE6OF01EDR5N.34.75.G09.1.454.CMB.1.raw
  modified_base (325)..(325): a, c, t, g, unknown or other
  misc_feature (325)..(325): n is a, c, g, or t
  modified_base (355)..(362): a, c, t, g, unknown or other
  misc_feature (355)..(362): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatccaccagcctgcagcctgaagatgtggcagtttattactgtcagcaatattatagtcctcgctcacgtttcggcgaggaccaaggtgagatcaaagactgtggctgcaccatctgtctcatctcccgcatctagaatcacgtntactgagtcggctggacaaggcgacatagnnnnnnnn

SEQ ID NO: 61252 - DNA, 453 bp, Homo sapiens
  misc_feature: GYAE6OF01C1UL0.34.75.G09.1.454.CMB.1.raw
  modified_base (229)..(229): a, c, t, g, unknown or other
  misc_feature (229)..(229): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (416)..(453): a, c, t, g, unknown or other
  misc_feature (416)..(453): n is a, c, g, or t
tcagtacacgtgatcacgaccggtgctcgatttagtatagacatcaagggacgtacttagcttggttccagccagaaacccagggactagccgtccttaagttgtctcatttcctggggcatctacccgggaatccggggtccctgaccgatttcaggtggcaggcgggtctgggacagatttcacttctcaccatcacagcctgcagcctgaagatgtggcaagtttntacgtgtcaaactgttggtctcaacactacggtggtacggttccggcaaacgggacctaaggtggaaaatcaaaacgacttggtcggctcggcaaccgntctggtactttcactccgttcccgctatcctagaacttcacgtatacgnggacggcggtctaggaccaagggcacgtaatgagnttcnnnnnnnnnnnnnnnnnnnnnnnnnnnnnnnnnnnnnn

SEQ ID NO: 61253 - DNA, 363 bp, Homo sapiens
  misc_feature: GYAE6OF01EU9FP.34.75.G09.1.454.CMB.1.raw
  modified_base (357)..(363): a, c, t, g, unknown or other
  misc_feature (357)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaacgaactgtggctgcaccatctgtctcatccttcccgcatctgaatcacgtgtactgagcgggctggcaaggcgcatagnnnnnnn

SEQ ID NO: 61254 - DNA, 371 bp, Homo sapiens
  misc_feature: GYAE6OF01E1MMC.34.75.G09.1.454.CMB.1.raw
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (355)..(361): a, c, t, g, unknown or other
  misc_feature (355)..(361): n is a, c, g, or t
  modified_base (363)..(371): a, c, t, g, unknown or other
  misc_feature (363)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcagtataataactggcctcggggacttcggccaagggaccaaggtggaattcaaacgactgtggctgcaccatctgtctnatcttcccgcatcngaatcacgtnactgagcggntggcaaggcncatagnnnnnnnannnnnnnnn

SEQ ID NO: 61255 - DNA, 395 bp, Homo sapiens
  misc_feature: GYAE6OF01ACORN.34.75.G09.1.454.CMB.1.raw
  modified_base (374)..(374): a, c, t, g, unknown or other
  misc_feature (374)..(374): n is a, c, g, or t
  modified_base (376)..(377): a, c, t, g, unknown or other
  misc_feature (376)..(377): n is a, c, g, or t
  modified_base (379)..(395): a, c, t, g, unknown or other
  misc_feature (379)..(395): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagattttcactctcaccatcaccagcctgcagcctgaagatgtggctagtttattactgtcagcaatatatagtcctccgctcacgtttcggcggaggaccaaggtggagatcaaacgaactgtaggctgcaccatctgtcttcattccttcccgctactctagaactcacgtgtactgacgtcgggctggactaaggccgacacgtagnanngnnnnnnnnnnnnnnnnn

SEQ ID NO: 61256 - DNA, 407 bp, Homo sapiens
  misc_feature: GYAE6OF01EHE6H.34.75.G09.1.454.CMB.1.raw
  modified_base (296)..(296): a, c, t, g, unknown or other
  misc_feature (296)..(296): n is a, c, g, or t
  modified_base (395)..(407): a, c, t, g, unknown or other
  misc_feature (395)..(407): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagttttatactgtcagctaatattatacgtccctccgctctacgtttcgggcggaaggaccaagggtgagtatacaaaacgactgngcgtcgccaccatccgtgttccttcacttccttccccgctatccgtagaacttcgacggttcgtacgtggacgtcggggctgggacaagggcacatagnnnnnnnnnnnnn

SEQ ID NO: 61257 - DNA, 379 bp, Homo sapiens
  misc_feature: GYAE6OF01ESLBV.34.75.G09.1.454.CMB.1.raw
  modified_base (365)..(379): a, c, t, g, unknown or other
  misc_feature (365)..(379): n is a, c, g, or t
tcagtacacgtgatcacgaccggtgctcgatttagtatagacatcagggactacttagcttggttccagcagaaacccaggacagcctcctaagttgctcatttcctgggcatctacccgggaatccggggtccctgaccgattcagtggcagcgggtctgggacagtatttcactctcaccatcaccagccctgcagcctgaagatgtggcagttttatactgtcagctaatattatacgtcctccgctcacgtttcggcggaggaccaaggtggagatcaaacgaactgtggctgcacatctgtctcatcttccgcatctagaactcgacgtcgtactcgagcggctggcaaggcgcagtagnnnnnnnnnnnnnnn

SEQ ID NO: 61258 - DNA, 453 bp, Homo sapiens
  misc_feature: GYAE6OF01EZN0Q.34.75.G09.1.454.CMB.1.raw
  modified_base (167)..(167): a, c, t, g, unknown or other
  misc_feature (167)..(167): n is a, c, g, or t
  modified_base (365)..(365): a, c, t, g, unknown or other
  misc_feature (365)..(365): n is a, c, g, or t
  modified_base (419)..(419): a, c, t, g, unknown or other
  misc_feature (419)..(419): n is a, c, g, or t
  modified_base (422)..(425): a, c, t, g, unknown or other
  misc_feature (422)..(425): n is a, c, g, or t
  modified_base (427)..(428): a, c, t, g, unknown or other
  misc_feature (427)..(428): n is a, c, g, or t
  modified_base (430)..(453): a, c, t, g, unknown or other
  misc_feature (430)..(453): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtcctgaccgattcagtggcagcgggtctgggacagtntttcactctcacctatccaccagcctagcagcctgaacgatgtggctagtttactactcgtacagacctaattattagtaccgtccctcgccttactacgtttcgggcggacgggaccaagggtgaagtataccaaaacgacttggcggctcggacactatacgtctaccgtactactccgttcccgctatccgtaanactccgacgttgtacgtaacgcggtacggtcgtaggacaaggtccatagtagangtnnnntnnannnnnnnnnnnnnnnnnnnnnnnn

SEQ ID NO: 61259 - DNA, 368 bp, Homo sapiens
  misc_feature: GYAE6OF01CT0MD.34.75.G09.1.454.CMB.1.raw
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (359)..(368): a, c, t, g, unknown or other
  misc_feature (359)..(368): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttatactgtcagcaatattatagtcctccgctcactttcggcggtagggaccaaggtggagatacaaacgactgngctgcacatctgtcttcatccttccncatctgaactcacgtgtactgaggcggtctggcaaggcgnatagnnnnnnnnnn

SEQ ID NO: 61260 - DNA, 428 bp, Homo sapiens
  misc_feature: GYAE6OF01CZE0Z.34.75.G09.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
  modified_base (405)..(428): a, c, t, g, unknown or other
  misc_feature (405)..(428): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcggtctgggacagatttcactctcaccatcacagcctgcagcctgaagntgtggactagttttatactgtcagactaatattatacgtcctccgnttcacgtttcggacggacgggaaccaagggtggaagaactacaaaacggtactggtacggctggaccacctatcgtgttccttcacttccttcccgcatctagaactcaacgtcgtactggacggcggtacgcggtanaacggccgtacgaagtnagnnnnnnnnnnnnnnnnnnnnnnnn

SEQ ID NO: 61261 - DNA, 419 bp, Homo sapiens
  misc_feature: GYAE6OF01CL3R5.34.75.G09.1.454.CMB.1.raw
  modified_base (203)..(203): a, c, t, g, unknown or other
  misc_feature (203)..(203): n is a, c, g, or t
  modified_base (379)..(379): a, c, t, g, unknown or other
  misc_feature (379)..(379): n is a, c, g, or t
  modified_base (385)..(419): a, c, t, g, unknown or other
  misc_feature (385)..(419): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagntgtggctagttttatactgtcagctaaatattatacgtcctcgctctacgtttcggcggagggaccaaggtgagatacaaacgatgtggctgcacgatctgtcttcactctcccgcattcagtaactcgacgtgtaacctggacgcggggtactgggacaaaggggtccacgtaanacggtnnnnnnnnnnnnnnnnnnnnnnnnnnnnnnnnnnn

SEQ ID NO: 61262 - DNA, 380 bp, Homo sapiens
  misc_feature: GYAE6OF01AMIQ8.34.75.G09.1.454.CMB.1.raw
  modified_base (373)..(380): a, c, t, g, unknown or other
  misc_feature (373)..(380): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatggtggctagtttattactgtcagcagtataataactggccgtccggggacgttcggaccgaagggaccaaggtggaattcaaacgaactgtaggctgcacatctgtcttcactccttcccgctatctgaactcacgttgtactgacggcggctggacaaggcgcatagnnnnnnnn

SEQ ID NO: 61263 - DNA, 453 bp, Homo sapiens
  misc_feature: GYAE6OF01AVR4M.34.75.G09.1.454.CMB.1.raw
  modified_base (166)..(166): a, c, t, g, unknown or other
  misc_feature (166)..(166): n is a, c, g, or t
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (402)..(453): a, c, t, g, unknown or other
  misc_feature (402)..(453): n is a, c, g, or t
tcagtacacgtgatcacgaccggtgctcgatttagtatagacatcagggactacttagcttggttccagcagaaaccaggacagcctcctaagttgctcatttcctgggcatctacccggaatccggggtccctgaccgattcagtggcagcgggtctgggacagnttttcactctcaccatcaccagcctgcagcctgaantgtggctagtttatactgtacagactaatattactacgtccctcgcctctacgtttcggcggaggaccaaggtggagtatacaaacgaactggtggctgccaccatccgtgttctcactccttcccgcatctaggaactccacggttgtactacggacggtcgggtcgtcggacctaagggccgtanaacgttancgagnnnnnnnnnnnnnnnnnnnnnnnnnnnnnnnnnnnnnnnnnnnnnnnnnnnn

SEQ ID NO: 61264 - DNA, 548 bp, Homo sapiens
  misc_feature: GYAE6OF01C9IW8.34.75.G09.1.454.CMB.1.raw
  modified_base (201)..(201): a, c, t, g, unknown or other
  misc_feature (201)..(201): n is a, c, g, or t
  modified_base (508)..(509): a, c, t, g, unknown or other
  misc_feature (508)..(509): n is a, c, g, or t
  modified_base (511)..(548): a, c, t, g, unknown or other
  misc_feature (511)..(548): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcacatcacagcctgcagcctgaagntgtggctagttttatactgtcagactaatattactagtccctccgtctctaccgtttcgggcggtaaggggaaccaaggggtggaagaacttaaccgaaaacggtaacgttgggtcggactccggacctaacccgtaacgtttccgttacggttcctttacctaaccgttttcccccgtttaccccggacccttaaactttcccggtaagtaaaccgttacccgtaaaccggttcggttaaaccgtcgggaaaccggggccggggtacttaacgggggccgaaaaaggggtccctaacgagttaggnngnnnnnnnnnnnnnnnnnnnnnnnnnnnnnnnnnnnnnn

SEQ ID NO: 61265 - DNA, 371 bp, Homo sapiens
  misc_feature: GYAE6OF01ATPS1.34.75.G09.1.454.CMB.1.raw
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
  modified_base (361)..(371): a, c, t, g, unknown or other
  misc_feature (361)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttatactgtcagcaatattatagtccctccgctcactttcggcgagggaccaaggtggagatacaaacgtaactgtggctgcgaccatctgtcttcatcctccgccatctnaatcacgtgtactgagcgggctggctaaggcgnatgnnnnnnnnnnn

SEQ ID NO: 61266 - DNA, 443 bp, Homo sapiens
  misc_feature: GYAE6OF01DC54G.34.75.G09.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (407)..(443): a, c, t, g, unknown or other
  misc_feature (407)..(443): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcggtctgggacagatttcactctcaccatcaccagcctgcagcctgaagatgnggctagtttatactgtcagctaatattnacgtcctccgtactctaacgttttcggcggtaacgggtaccaaggttggaagtataccaaaacgaactggtcggctagcaaccgtatcgtatcctacgactccttacccgcctactctagtaactcgacgtagtaccttggacgtcggacgtcggacgaacgcgcaatagcagnnnnnnnnnnnnnnnnnnnnnnnnnnnnnnnnnnnnn

SEQ ID NO: 61267 - DNA, 371 bp, Homo sapiens
  misc_feature: GYAE6OF01D9489.34.75.G09.1.454.CMB.1.raw
  modified_base (288)..(288): a, c, t, g, unknown or other
  misc_feature (288)..(288): n is a, c, g, or t
  modified_base (362)..(371): a, c, t, g, unknown or other
  misc_feature (362)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttatacgtgtcagcaatattatagtcctccgctcacgtttcggcggagggaccaaggtggagatacaaagactgnggctgcacatctgtcttcattcctccgctatctgaactcacgtgtactgagtcggctcggcaaggcgacatagnnnnnnnnnn

SEQ ID NO: 61268 - DNA, 462 bp, Homo sapiens
  misc_feature: GYAE6OF01BPQ6Y.34.75.G09.1.454.CMB.1.raw
  modified_base (443)..(462): a, c, t, g, unknown or other
  misc_feature (443)..(462): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcaggcgggtctgggacagtatttcactctcaccatcaccagactggacgcctgaagtatttgctagttgtatttactgtacaactagttggtctacaactacgtacggtcggtacgttccggaccgaaacgggaccaaagggtaggaaaataccgaaaaacggaacgttggtcggcttcgaccaccgtatcgtcgttccttcaacttcccttccccgacctaagttctagtaactccgtaacggttcgtacgtggacggtccgggtcgtacgggacgaacgggcgatacgtagnnnnnnnnnnnnnnnnnnnn

SEQ ID NO: 61269 - DNA, 396 bp, Homo sapiens
  misc_feature: GYAE6OF01AWZB3.34.75.G09.1.454.CMB.1.raw
  modified_base (384)..(396): a, c, t, g, unknown or other
  misc_feature (384)..(396): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagttttattactgtcagctaattattatacgtcctccgctctacgtttcggcggagggaccaaggtggagatacaaacgactgtggctgcaccatcttgtcttcacttccgttcccgcctatctagtaactctacgtgtacctggacggcgggctggacaagggcactagtagnnnnnnnnnnnnn

SEQ ID NO: 61270 - DNA, 422 bp, Homo sapiens
  misc_feature: GYAE6OF01C3AT6.34.75.G09.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (381)..(386): a, c, t, g, unknown or other
  misc_feature (381)..(386): n is a, c, g, or t
  modified_base (388)..(422): a, c, t, g, unknown or other
  misc_feature (388)..(422): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtcccngacgnttcagtggcagcgggtctgggacagtatttcactctcaccatcaccagcctgccagcctgaaagatgtgctagtttatctgtcanacaattagttatatccgtaccactntaccttgggcggaggaacgaaggnggaatactactaaaaggctgtggacngaccacttaatcctgttcactacgtcctccgacagtaccgtanactcgagcgtactggcgtgcngaagtagccngttancnnnnnngnnnnnnnnnnnnnnnnnnnnnnnnnnnnnnnnnnn

SEQ ID NO: 61271 - DNA, 392 bp, Homo sapiens
  misc_feature: GYAE6OF01EPRJ6.34.75.G09.1.454.CMB.1.raw
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
  modified_base (377)..(392): a, c, t, g, unknown or other
  misc_feature (377)..(392): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttattactgtcagactaatattatagtccctcgcttcacgtttcggcggagggaccaaggtggagatacaaacgaactgtggctgcaccatctgtctntactcctcccgctatctgaactctacgtntacngacggcgggctggacgaggcgtcaataggnagnnnnnnnnnnnnnnnn

SEQ ID NO: 61272 - DNA, 371 bp, Homo sapiens
  misc_feature: GYAE6OF01AIX22.34.75.G09.1.454.CMB.1.raw
  modified_base (363)..(371): a, c, t, g, unknown or other
  misc_feature (363)..(371): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttattactgtcagcaatattatagtcctccgctcacgtttcggcggagggaccaaggtggagatacaaacgaactgtggctgcacctatctgtcttcactcttcccgccatctgaatcacggtactgagcgggctggcaaggcgcatagnnnnnnnnn

SEQ ID NO: 61273 - DNA, 454 bp, Homo sapiens
  misc_feature: GYAE6OF01EUFDM.34.75.G09.1.454.CMB.1.raw
  modified_base (207)..(207): a, c, t, g, unknown or other
  misc_feature (207)..(207): n is a, c, g, or t
  modified_base (410)..(410): a, c, t, g, unknown or other
  misc_feature (410)..(410): n is a, c, g, or t
  modified_base (412)..(454): a, c, t, g, unknown or other
  misc_feature (412)..(454): n is a, c, g, or t
tcagtacacgtgatcacgaccggtgctcgatttagtatagacatcagggactacttagcttggttccagcagaaaccaggacagcctcctaagttgctcatttcctgggcatctacccggggaatccggggtccctgaccgattcagtggcaggcgggtctgggacagattttcactctcaccatcaccagccctgcagcctgaagngtgtggctagtttatatgtcagcaattattatacgtcctccgtctctacgtttcgggacggaacgggacctaagggtggagtactacaaaacggtacctggtaggctgaccctacagttctgtccttcacttcccttcccgctatcttagaacttccgacgtctacgtgacggcgggctaggactaagggccgtcaagtagcngnnnnnnnnnnnnnnnnnnnnnnnnnnnnnnnnnnnnnnnnnnn

SEQ ID NO: 61274 - DNA, 342 bp, Homo sapiens
  misc_feature: GYAE6OF01B96VF.34.75.G09.1.454.CMB.1.raw
  modified_base (108)..(108): a, c, t, g, unknown or other
  misc_feature (108)..(108): n is a, c, g, or t
  modified_base (256)..(256): a, c, t, g, unknown or other
  misc_feature (256)..(256): n is a, c, g, or t
  modified_base (306)..(342): a, c, t, g, unknown or other
  misc_feature (306)..(342): n is a, c, g, or t
tcagtacacgtgatcacgaccggtgctcgatttagtatagacatcagggactacttagcttggttccagcaagaaaccaggacagcctcctaagttgctctatttccngggcatccgtaaccgggaagtccgggtcctgaccattcgagtggcaggtcgggtctgggaacagtatttcacttctaccaacactcaaccgcgcctgacacgtcgtagaagagttggacggtacttaaggtttacttacgtgactaanactaaaattattacgtacgtcctcctacgtactacggttccgggacgggnnnnnnnnnnnnnnnnnnnnnnnnnnnnnnnnnnnnn

SEQ ID NO: 61275 - DNA, 410 bp, Homo sapiens
  misc_feature: GYAE6OF01BB5VI.34.75.G09.1.454.CMB.1.raw
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (369)..(410): a, c, t, g, unknown or other
  misc_feature (369)..(410): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttatactgtcagcaatattatacgtcctcgctctactttcggcggaggaccaaggtgagatcaaacgactgtcggctgcaccatctgtcttcatcctccgctatctcgaatcagtgtactgagcgggntggcgaagcgtacatagctagcancgannnnnnnnnnnnnnnnnnnnnnnnnnnnnnnnnnnnnnnnnn

SEQ ID NO: 61276 - DNA, 557 bp, Homo sapiens
  misc_feature: GYAE6OF01CWOW5.34.75.G09.1.454.CMB.1.raw
  modified_base (186)..(186): a, c, t, g, unknown or other
  misc_feature (186)..(186): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (518)..(557): a, c, t, g, unknown or other
  misc_feature (518)..(557): n is a, c, g, or t
tcagtacacgtgatcacgaccggtgctcgatttagtatagacatcagggactacttagcttggttccagcagaaaccaggacagcctcctaagttgctcatttcctgggcatctacccgggatccggggtcctgaccgattcagtggcagcgggtctgggacagatttcactctcaccatccacancctgcagccgtagaaagtagtggtagggtacttaagtttttagtacttaggttacagtactaaaattactttaagtaccgttacctacccgtcttacgttaccggtttcgggacgggtacgggaaccgagggttagacgacgtaacgaaacgtagtggnggtccncggacctacgtacttcgttcttacgtccgtaaccttcccgttacccgtactaattcccgtaacgtaccgtaccgtacggtttcgttaaccggtagggtacgggtccggtacgtcggggaccgtaaaggtccgtagtaacgtgnctaagntacgngntacggntngannnnnnnnnnnnnnnnnnnnnnnnnnnnnnnnnnnnnnnn

SEQ ID NO: 61277 - DNA, 466 bp, Homo sapiens
  misc_feature: GYAE6OF01CEC7D.34.75.G09.1.454.CMB.1.raw
  modified_base (434)..(434): a, c, t, g, unknown or other
  misc_feature (434)..(434): n is a, c, g, or t
  modified_base (438)..(466): a, c, t, g, unknown or other
  misc_feature (438)..(466): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttattactgtcagcaatattatacgtcctccgctcgtaccgtttcgggcgggtaacgggaacccgaagggttggagaacgtacgaaaacgaacgtgtaggcctagccacctattctcgttcttactagttcccttccccgcctattccctagtaacttccgaacgttgtaaccgtggaacgggcggggtcgacgggtccgaaacgggtcaccgtaagtagngacnnnnnnnnnnnnnnnnnnnnnnnnnnnnn

SEQ ID NO: 61278 - DNA, 437 bp, Homo sapiens
  misc_feature: GYAE6OF01AHYZ8.34.75.G09.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (306)..(306): a, c, t, g, unknown or other
  misc_feature (306)..(306): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (396)..(437): a, c, t, g, unknown or other
  misc_feature (396)..(437): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctagaagntggtggctagttttatactgtcagctaattnttactagttccctccgctcacgtttcggcggtagggaccaagggtgagatacaaacgatgtggctgccacntctgtcttcatccttcccgctatctagtactcgtacgtgtactggacggcggtcgtggacaaggtcgacgtaagtagctagcntnacgtnnnnnnnnnnnnnnnnnnnnnnnnnnnnnnnnnnnnnnnnnn

SEQ ID NO: 61279 - DNA, 481 bp, Homo sapiens
  misc_feature: GYAE6OF01A4GAF.34.75.G09.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
  modified_base (439)..(481): a, c, t, g, unknown or other
  misc_feature (439)..(481): n is a, c, g, or t
tcagtacacgtgatcacgaccggtgctcgatttagtatagacatcagggactacttagcttggttccagcagaaaccaggacagcctcctaagttgctcatttcctgggcatctacccgggaatcccggggtccctgaccgattcagtggcagcgggtctgggacagtatttcactctcaccatccaccagccctgcagcctgaagntgtggctagttttatacngtcagctaattattanacgtccctccgcttctacgttcgggacggagggaccaagggtganactacaaaacgagtggtcggctgaccaccgtattcttcgttccttacgactttccccgttcccgactacttccgtaagtaaactccgtaaggttcgtacgtacgggacggtccggggtctacggggacaaacggggccctataaggtagcagnnnnnnnnnnnnnnnnnnnnnnnnnnnnnnnnnnnnnnnnnnn

SEQ ID NO: 61280 - DNA, 421 bp, Homo sapiens
  misc_feature: GYAE6OF01BCJJO.34.75.G09.1.454.CMB.1.raw
  modified_base (399)..(421): a, c, t, g, unknown or other
  misc_feature (399)..(421): n is a, c, g, or t
tcagtacacgtgatcacgaccggtgctcgattttagtatagacatcagggacgtacttagcttggttccagctagaaaccaggacagcctcctaaggttgctcatttcctgggctatctacccgggaatccgggtcctgaccgattcagtggcagcggttctgggacagatttcactctcaccatcaccagcctgcagcctgaagatgtggctagttttattactgtcagctaattattatacgtcctccgcttcacgtttcggcggaggaccaaggtgagtatcaaacgatgtggctagcaccattctgtcttcgattccttcccgctaattctagaaacttcgacgttagttccgtggacggtcggggactcgggaacaaggggcacgagttacggnnnnnnnnnnnnnnnnnnnnnnn

SEQ ID NO: 61281 - DNA, 396 bp, Homo sapiens
  misc_feature: GYAE6OF01AWCLB.34.75.G09.1.454.CMB.1.raw
  modified_base (156)..(156): a, c, t, g, unknown or other
  misc_feature (156)..(156): n is a, c, g, or t
  modified_base (202)..(202): a, c, t, g, unknown or other
  misc_feature (202)..(202): n is a, c, g, or t
  modified_base (357)..(357): a, c, t, g, unknown or other
  misc_feature (357)..(357): n is a, c, g, or t
  modified_base (377)..(396): a, c, t, g, unknown or other
  misc_feature (377)..(396): n is a, c, g, or t
tcagtacacgtgatcacgaccggtgctcgatttagtatagacatcagggactacttagcttggttccagcagaaaccaggacagcctcctaagttgctcatttcctgggcatctacccgggatccgggtcctgaccgattcagtgcaggcgggtcngggacagatttcactctcaccatccaccagcctgcagccgtgaagntgtcggctagttttactactgtacagactaattattactacgtccctcgctctacgttcggacggaggaccaaggtgagatacaaacgactgtgctgacacatctgtcttcatccttcccgctatcgtagactcgagttcgtacgtgaggcggtntggacgaaggcacagtaggnnnnnnnnnnnnnnnnnnnn

SEQ ID NO: 61282 - DNA, 572 bp, Homo sapiens
  misc_feature: GYAE6OF01EEFGK.34.75.G09.1.454.CMB.1.raw
  modified_base (373)..(373): a, c, t, g, unknown or other
  misc_feature (373)..(373): n is a, c, g, or t
  modified_base (521)..(521): a, c, t, g, unknown or other
  misc_feature (521)..(521): n is a, c, g, or t
  modified_base (524)..(572): a, c, t, g, unknown or other
  misc_feature (524)..(572): n is a, c, g, or t
tcagtacacgtgatcacgaccggtgctcgatttagtatagacatcagggactacttagcttggttccagcagaaaccaggacagcctcctaagttgcttcatttcctgggcatcctacccgggaatccggggtccctgaccgattcagtggcaggcgggtctgggactagtatttcactctcacatcaccagcctgcagcctgaagtatggtggtacttaagttttattacgtgtacgaagactaattagtttaagtaccgtccccttccgcctttcgtacggttttaccggggacgggtaacgggaacccggtaaggggttggaacgtagtaaaccgaaacgtaagtgtacgggcctacgcccgtaaacctnttaccgttcgtttaccttacgtacccttttcccgttaccccgccttaacgttacgttacgaaacgttttccgaacggtttacgttaaccggtaggaccggggtcggggttaccgtcggggaacgtaacggggtacacgtaaagtgacntcnnnnnnnnnnnnnnnnnnnnnnnnnnnnnnnnnnnnnnnnnnnnnnnnn

SEQ ID NO: 61283 - DNA, 395 bp, Homo sapiens
  misc_feature: GYAE6OF01EJSVW.34.75.G09.1.454.CMB.1.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (372)..(373): a, c, t, g, unknown or other
  misc_feature (372)..(373): n is a, c, g, or t
  modified_base (375)..(382): a, c, t, g, unknown or other
  misc_feature (375)..(382): n is a, c, g, or t
  modified_base (385)..(395): a, c, t, g, unknown or other
  misc_feature (385)..(395): n is a, c, g, or t
tcagtacacgtgatcacgaccggtgctcgatttagtatagacatcagggactacttagcttggttccagcagaaaccaggacagcctcctaaagttgctcatttcctgggcatctacccgggaatccggggtccctgaccgattcagtggcagcgggtctgggacagatttcactctcaccatcaccagcctgcagcctgaagatgtggctagtttattactgtcaagcaaatattatacgtcctccgctcactttcggcggaggacaaggtgagatacaaacgactgtggctgcgaaccatctgtcctntatacctcccgcactctagaactctacgtntactgagcgggctggactaggcgacgatagcnngnnnnnnnnttnnnnnnnnnnn

SEQ ID NO: 61284 - DNA, 515 bp, Homo sapiens
  misc_feature: GYAE6OF01CBFAS.34.75.G09.1.454.CMB.1.raw
  modified_base (80)..(80): a, c, t, g, unknown or other
  misc_feature (80)..(80): n is a, c, g, or t
  modified_base (139)..(139): a, c, t, g, unknown or other
  misc_feature (139)..(139): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (356)..(356): a, c, t, g, unknown or other
  misc_feature (356)..(356): n is a, c, g, or t
  modified_base (465)..(465): a, c, t, g, unknown or other
  misc_feature (465)..(465): n is a, c, g, or t
  modified_base (467)..(515): a, c, t, g, unknown or other
  misc_feature (467)..(515): n is a, c, g, or t
tcagtacacgtgatcacgaccggtgctcgatttagtatagacatcgaggggactacttagcttggttccagcagaaaccnggacagcctcctaagttgctctagtttcctgggcatctaacccgggaatccggggtccngaccgattcagtggctaggcgggtctgggacagtactttcactctcacatcaccagcctgcagctgagntggtggctagtttatacngtcgaagctaatatatcgtccctcgcttctcgtttcggacggtagggacctaagggtgagatacaaaaggtctggtcggctcggactaccgtaacgtctcggtaccttacgtacgttcccggtttacccnccgtaattccgtaggtaaaccttaccggaaacgtttgaacccgttacggttagggaacggttcggggacgttaacgggacgaaacgggtccgtacaagtaggcattgangnnnnnnnnnnnnnnnnnnnnnnnnnnnnnnnnnnnnnnnnnnnnnnnnn

SEQ ID NO: 61285 - DNA, 450 bp, Homo sapiens
  misc_feature: GYAE6OF01BXLVK.34.75.G09.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
  modified_base (418)..(450): a, c, t, g, unknown or other
  misc_feature (418)..(450): n is a, c, g, or t
tcagtacacgtgatcacgaccggtgctcgatttagtatagacatcagggactacttagcttggttccagcagaaaccaggacagcctcctaagttgctcatttccgtgggcatctacccgggaatccggggtccctgaccgattcagtgcagcgggtctgggacagatttcactctcacatcaccagcctgcacgcctagaagntggtggctaagtttacttacgtgtacagtactaaattatttataccgttccctccgtcttctaccgtttcggacggacgggacctaagggngagactacgaaacgtacgtggtcggcttgcctaccgattctacgtcttatctccttcccgactcgtctagtactcgaacgtcgtacnggacgcgggtcgtaggacgtaggacgcagtancgannnnnnnnnnnnnnnnnnnnnnnnnnnnnnnnn

SEQ ID NO: 61286 - DNA, 506 bp, Homo sapiens
  misc_feature: GYAE6OF01DDI7O.34.75.G09.1.454.CMB.1.raw
  modified_base (78)..(78): a, c, t, g, unknown or other
  misc_feature (78)..(78): n is a, c, g, or t
  modified_base (108)..(108): a, c, t, g, unknown or other
  misc_feature (108)..(108): n is a, c, g, or t
  modified_base (162)..(162): a, c, t, g, unknown or other
  misc_feature (162)..(162): n is a, c, g, or t
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (450)..(451): a, c, t, g, unknown or other
  misc_feature (450)..(451): n is a, c, g, or t
  modified_base (456)..(458): a, c, t, g, unknown or other
  misc_feature (456)..(458): n is a, c, g, or t
  modified_base (461)..(462): a, c, t, g, unknown or other
  misc_feature (461)..(462): n is a, c, g, or t
  modified_base (466)..(506): a, c, t, g, unknown or other
  misc_feature (466)..(506): n is a, c, g, or t
tcagtacacgtgatcacgaccggtgctcgatttagtatagacatcagggactacttagcttggttccagcagaaaccnggacagcctcctaagttgctctatttccgngggcatccgtaacccgggtaagttcccgggggtacctggaaccgtattcgaggnggctcgggcgggtctagggacaggtacttcacttcaccacatccaaccgntcccagctagtccgtagaagtcgcgtcggacttacggttattaccgtgactagtataattagtactgtttccccnctntcgtaccggtggacgggacggtagaggtgacgacgtaacaaagtcgtcgaggcacggtacctaatntaccgtnttcgtaccctccggttccttaccgcgtacttcgacggactcggttaacgcgttagcggtacggngagtccgaaagcncgtcngacgnngctgnnntannctannnnnnnnnnnnnnnnnnnnnnnnnnnnnnnnnnnnnnnnn

SEQ ID NO: 61287 - DNA, 580 bp, Homo sapiens
  misc_feature: GYAE6OF01CAGVZ.34.75.G09.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (403)..(403): a, c, t, g, unknown or other
  misc_feature (403)..(403): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(567): a, c, t, g, unknown or other
  misc_feature (564)..(567): n is a, c, g, or t
  modified_base (572)..(572): a, c, t, g, unknown or other
  misc_feature (572)..(572): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
tcagtacacgtgatcacgaccggtgctcgatttagtatagacatcagggactacttagcttggttccagcagaaaccaggacagcctcctaagttgctcatttcctgggcatcgtacccgggatcccggggtccctgaccgattcaggtggcaggcgggtctgggacagtactttccactctccaccatccaccngcctncagtcctagaangttgtacggtacttagtttacttacgttgactagtactaattagttactacgtcctaccgacttcgtacgttcggaggacggtaacgtagggtacgagtactaacggaaacgtgtacggtcgtacgacacctaccttatcccgttatccttacgtacctttcccgtcccgacttaattccgtaagttaacnccggttaacgttcggtacgtcgggaacggcggttccgagggaacccggcgacgtaacgttaagcgacgtagngcttanacnctctacagnactnatacgtactacacntangtcacgatctactcgtcgnacagtgngctacngtntntcangtacntnannnnacgcncanngnac

SEQ ID NO: 61288 - DNA, 668 bp, Homo sapiens
  misc_feature: GYAE6OF01AZS3Q.34.75.G09.1.454.CMB.1.raw
  modified_base (201)..(201): a, c, t, g, unknown or other
  misc_feature (201)..(201): n is a, c, g, or t
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
  modified_base (608)..(608): a, c, t, g, unknown or other
  misc_feature (608)..(608): n is a, c, g, or t
  modified_base (658)..(658): a, c, t, g, unknown or other
  misc_feature (658)..(658): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtgcagcggtctgggacagatttcactctcaccatcaccagcctgcagcctgaagntgtggctagtttattacctgtcagactaatactttatacggttccctccgcttccgtaacgttttccggggcgggtaacgggtaacccgtaaaggggttcggaaacggtaacgttaaccgaaaaacggtaaccgttggttacgggaccttacggacctaaccgtaacgtttccgtttacggttaccttttacctacgttacccgttttccccggaccttaacgtttcgttaacgtaaacgttcccgtaacggttacgttaaccggttggaaccggtccggggtacgttacgggaccgaaaacggggtcccacgtaaacgttacggactcggacagcgtacgcattcgctacgngtacngtcgcgcgacgcgtgactacgcgacgctagtacgtacgacactactacncgtcgtgactgtacgtacgtctgtcgtcgagcgtcgacgacgctctacancgtgtcgtcg

SEQ ID NO: 61289 - DNA, 456 bp, Homo sapiens
  misc_feature: GYAE6OF01BQAVM.34.75.G09.1.454.CMB.1.raw
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (422)..(456): a, c, t, g, unknown or other
  misc_feature (422)..(456): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcaggcgggtctgggacagtatttcactctcaccatccaccagccctgcagcctgaagatgtggctagtttattactgtcagctaaatattatacgtcctccgctctacgtttcggcggacggaccaaggtggaagatacaaaacgtaactggtggactgtaccacctatctggtccttcgaacttcctcccgcctactctagaaacttcgaacgttcgtactggaggtccgggagtgggtaccaaacgggtcggactaacgttagngantgannnnnnnnnnnnnnnnnnnnnnnnnnnnnnnnnnn

SEQ ID NO: 61290 - DNA, 363 bp, Homo sapiens
  misc_feature: GYAE6OF02HH6K3.34.75.G09.1.454.CMB.1.raw
  modified_base (359)..(363): a, c, t, g, unknown or other
  misc_feature (359)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnnnn

SEQ ID NO: 61291 - DNA, 389 bp, Homo sapiens
  misc_feature: GYAE6OF02FFGHU.34.75.G09.1.454.CMB.1.raw
  modified_base (363)..(389): a, c, t, g, unknown or other
  misc_feature (363)..(389): n is a, c, g, or t
tcagtacacgtgatcacgaccggtgctcgatttagtatagacatcagggactacttagcttggttccagcagaaaccaggacagcctcctaagttgctcatttcctgggcattctacccgggaatccggggtccctgacccgattcagtggcagcgggtctgggacagatttcactctcaccatcaccagcctgcagcctgaagatgtggcagtttattactgtcagcaatattatagtcctccgctcactttcggcggaggaccaaggtcggagaaaaatcaaacgaactgtggctgcacatctgtcttcatcttccgccatctgatcacgtgtactgagcgggctggcgaaggcgcatagnnnnnnnnnnnnnnnnnnnnnnnnnnn

SEQ ID NO: 61292 - DNA, 361 bp, Homo sapiens
  misc_feature: GYAE6OF02H668S.34.75.G09.1.454.CMB.1.raw
  modified_base (345)..(345): a, c, t, g, unknown or other
  misc_feature (345)..(345): n is a, c, g, or t
  modified_base (351)..(361): a, c, t, g, unknown or other
  misc_feature (351)..(361): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtggagatcaaacgactgtgctgcaccatctgtctcatcttccgcatctgaatcacgtgtactgagcggctggcaaggcncatagnnnnnnnnnnn

SEQ ID NO: 61293 - DNA, 362 bp, Homo sapiens
  misc_feature: GYAE6OF02F56VI.34.75.G09.1.454.CMB.1.raw
  modified_base (357)..(362): a, c, t, g, unknown or other
  misc_feature (357)..(362): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcgagggaccaaggtggagatcaaacgaactgtggctgcaccatctgtcttcatcttccgccatctgaatcacgtgtactgagcgggctggcaaggcgcatagnnnnnn

SEQ ID NO: 61294 - DNA, 362 bp, Homo sapiens; identical to SEQ ID NO: 61293
  misc_feature: GYAE6OF02JC965.34.75.G09.1.454.CMB.1.raw
  modified_base (357)..(362): a, c, t, g, unknown or other
  misc_feature (357)..(362): n is a, c, g, or t

SEQ ID NO: 61295 - DNA, 364 bp, Homo sapiens
  misc_feature: GYAE6OF02I1AU4.34.75.G09.1.454.CMB.1.raw
  modified_base (243)..(243): a, c, t, g, unknown or other
  misc_feature (243)..(243): n is a, c, g, or t
  modified_base (354)..(364): a, c, t, g, unknown or other
  misc_feature (354)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgntcactttcggcggagggaccaaggtggagatcaaacgaactgtggctgcaccatctgtctcatctccgcatctgaatcacgtgtactgagcgggctggcaaggcgcatagnnnnnnnnnnn

SEQ ID NO: 61296 - DNA, 357 bp, Homo sapiens
  misc_feature: GYAE6OF02FO746.34.75.G09.1.454.CMB.1.raw
  modified_base (351)..(357): a, c, t, g, unknown or other
  misc_feature (351)..(357): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcgaggaccaaggtggagatcaaacgactgtggctgcacatctgtcttcatcttccgcatctgaatcacgtgtactgagcggctggcaaggcgcatagnnnnnnn

SEQ ID NO: 61297 - DNA, 377 bp, Homo sapiens
  misc_feature: GYAE6OF02GY399.34.75.G09.1.454.CMB.1.raw
  modified_base (353)..(353): a, c, t, g, unknown or other
  misc_feature (353)..(353): n is a, c, g, or t
  modified_base (359)..(377): a, c, t, g, unknown or other
  misc_feature (359)..(377): n is a, c, g, or t
tcagtacacgtgatcacgaccggtgctcgatttagtatagacatcagggactacttagcgttggttccagcagaaaccaggacagcctcctaagttgctcaatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtggagatcaaacgaactgtcggctgcaccatctgtcttcatcttccgccatctgaatcacgtgtactgagcgggctggcaaggcncatagnnnnnnnnnnnnnnnnnnn

SEQ ID NO: 61298 - DNA, 366 bp, Homo sapiens
  misc_feature: GYAE6OF02GZXQG.34.75.G09.1.454.CMB.1.raw
  modified_base (358)..(366): a, c, t, g, unknown or other
  misc_feature (358)..(366): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggagggaccaaggtggagatcaaacgaactgtggctgcaccatctgtcttcatcttcccgccatctgaatcacgtgtactgagcgggctggcaaggcgcatagnnnnnnnnn

SEQ ID NO: 61299 - DNA, 389 bp, Homo sapiens
  misc_feature: GYAE6OF02GBZCG.34.75.G09.1.454.CMB.1.raw
  modified_base (374)..(389): a, c, t, g, unknown or other
  misc_feature (374)..(389): n is a, c, g, or t
tcagtacacgtgatcacgaccggtgctcgatttagtatagacatcagggacgtacttagcttggttccagccagaaacccagggactagcctccttaagttgtctcatttcctggggcatcctacccgggaatccggggtccctgaccgattcaggtggcagcgggtctgggactagatttcacttactcaccatcaccagcctgcagcctgaagagtgtggcagtttattacgtgtcaacagtttggtctcacacacgtggacgttcggccaagggacctaaggtggaaaatcaaagactgtggctggcaccatctggtctcatcttcccgcatctgaatcacgtgtactgagcggctggctaaggcgcatgnnnnnnnnnnnnnnnn

SEQ ID NO: 61300 - DNA, 364 bp, Homo sapiens
  misc_feature: GYAE6OF02GLKEH.34.75.G09.1.454.CMB.1.raw
  modified_base (361)..(364): a, c, t, g, unknown or other
  misc_feature (361)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaaatattatagtcctccgctcactttcggcggagggaccaaggtggagatcaaaacgaactgtggctgcaccatctgtcttcatcttcccgccatctgaatcacgtgtactgagcgggctggcaaggcgcatagnnnn

SEQ ID NO: 61301 - DNA, 364 bp, Homo sapiens
  misc_feature: GYAE6OF02GY95B.34.75.G09.1.454.CMB.1.raw
  modified_base (356)..(364): a, c, t, g, unknown or other
  misc_feature (356)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaacgaactgtggctgcaccatctgtcttcatcttccgccatctgaatcacgtgtactgagcggctggcaaggcgcatagnnnnnnnnn

SEQ ID NO: 61302 - DNA, 367 bp, Homo sapiens
  misc_feature: GYAE6OF02F1YJ3.34.75.G09.1.454.CMB.1.raw
  modified_base (361)..(367): a, c, t, g, unknown or other
  misc_feature (361)..(367): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagacttcactctcaccatcagcagacttgagcctgaagattttgcagtttattactgtcagcagtataataactggcctccggggacgttcggccaagggaccaaggtggaattcaaacgaactgtggctgcaccatctgtcttcatcttcccgcatctgaatcacgtgtactgagcgggctggcaaggcgcatagnnnnnnn

SEQ ID NO: 61303 - DNA, 562 bp, Homo sapiens
  misc_feature: GYAE6OF02G7NUE.34.75.G09.1.454.CMB.1.raw
  modified_base (535)..(562): a, c, t, g, unknown or other
  misc_feature (535)..(562): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagccctgcgacgtcctagaagtagtgtacgaacttaagttttaacttacgttcgtacagactaaattattaatacgtccctccgctacttacgttcgggacgggtacggaacctaagggtggaagtactaaccgaaaaaccgtaacgttggtacggtctcggacccaacctacttccgttcggtttacctttacctaacttttcccccgtttaccccccggacttaactttcccgttaaaggtaaaccttccccggtaaccgggtttacgttaacccgttagggaaccgggggtcccgggggttacgttacggggaaccggtaaacggggccctaaacgtaagttaggnnnnnnnnnnnnnnnnnnnnnnnnnnnn

SEQ ID NO: 61304 - DNA, 383 bp, Homo sapiens
  misc_feature: GYAE6OF02H47X8.34.75.G09.1.454.CMB.1.raw
  modified_base (368)..(383): a, c, t, g, unknown or other
  misc_feature (368)..(383): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggagggaccaaaggtggagatcaaaacgaactgtggctgcaccatctgtcttcgtcttccgcccactactgaatacacgtgtacttgagacgggcgtgcgaaggcgcgactagnnnnnnnnnnnnnnnn

SEQ ID NO: 61305 - DNA, 358 bp, Homo sapiens
  misc_feature: GYAE6OF02FFM5T.34.75.G09.1.454.CMB.1.raw
  modified_base (354)..(358): a, c, t, g, unknown or other
  misc_feature (354)..(358): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcgaggaccaaggtggagatcaaacgaactgtggctgcaccatctgtcttcatcttccgcatctgaatcacgtgtactgagcgggctggcaaggcgcatagnnnnn

SEQ ID NO: 61306 - DNA, 361 bp, Homo sapiens
  misc_feature: GYAE6OF02GRZEO.34.75.G09.1.454.CMB.1.raw
  modified_base (358)..(361): a, c, t, g, unknown or other
  misc_feature (358)..(361): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcgagggaccaaggtggaaatcaaacgaactgtggctgcaccatctgtcttcatcttcccgccatctgaatcacgtgtactgagcgggctggcaaggcgcatagnnnn

SEQ ID NO: 61307 - DNA, 366 bp, Homo sapiens
  misc_feature: GYAE6OF02IM9QY.34.75.G09.1.454.CMB.1.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (356)..(366): a, c, t, g, unknown or other
  misc_feature (356)..(366): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggagggaccaaggtggagatcaaacgactgtggctgcaccatctgtcttcatcttcccgcatctgaatcacgtntactgagcggctggcaaggcncatagnnnnnnnnnnn

SEQ ID NO: 61308 - DNA, 361 bp, Homo sapiens
  misc_feature: GYAE6OF02FIDTK.34.75.G09.1.454.CMB.1.raw
  modified_base (357)..(361): a, c, t, g, unknown or other
  misc_feature (357)..(361): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggagggaccaaggtggagatcaaacgaactgtggctgcaccatctgtcttcatcttccgccatctgaatcacgtgtactgagcgggctggcaaggcgcatagnnnnn

SEQ ID NO: 61309 - DNA, 365 bp, Homo sapiens
  misc_feature: GYAE6OF02FGOLL.34.75.G09.1.454.CMB.1.raw
  modified_base (359)..(365): a, c, t, g, unknown or other
  misc_feature (359)..(365): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagnnnnnnn

SEQ ID NO: 61310 - DNA, 358 bp, Homo sapiens
  misc_feature: GYAE6OF02I219X.34.75.G09.1.454.CMB.1.raw
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (352)..(358): a, c, t, g, unknown or other
  misc_feature (352)..(358): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctctacttcggcggaggaccaaggtggagatcaaacgactgtggctgcacatctgtctcatctccgcatctagatcacgtntactgagcggntggacaaggcncatagnnnnnnn

SEQ ID NO: 61311 - DNA, 363 bp, Homo sapiens
  misc_feature: GYAE6OF02F05JW.34.75.G09.1.454.CMB.1.raw
  modified_base (354)..(363): a, c, t, g, unknown or other
  misc_feature (354)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctcgctcactttcggcggaggaccaaggtggagatcaaacgactgtggctgcaccatctgtcttcatcttccgccatctgaatcacgtgtactgagcgggctggcaaggcgcatagnnnnnnnnnn

SEQ ID NO: 61312 - DNA, 366 bp, Homo sapiens
  misc_feature: GYAE6OF02ISBBG.34.75.G09.1.454.CMB.1.raw
  modified_base (359)..(366): a, c, t, g, unknown or other
  misc_feature (359)..(366): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggagggaccaaggtggagatcaaacgaactgtggctgcaccatctgtcttcatcttcccgccatctgaatcacgtgtactgagcgggctggcaaggcgcatagnnnnnnnn

SEQ ID NO: 61313 - DNA, 363 bp, Homo sapiens
  misc_feature: GYAE6OF02FV286.34.75.G09.1.454.CMB.1.raw
  modified_base (352)..(352): a, c, t, g, unknown or other
  misc_feature (352)..(352): n is a, c, g, or t
  modified_base (358)..(363): a, c, t, g, unknown or other
  misc_feature (358)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcggctggcaaggcncatagnnnnnn

SEQ ID NO: 61314 - DNA, 364 bp, Homo sapiens
  misc_feature: GYAE6OF02GXKA9.34.75.G09.1.454.CMB.1.raw
  modified_base (356)..(364): a, c, t, g, unknown or other
  misc_feature (356)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctcgctcactttcggcggagggaccaaggtggagatcaaacgaactgtggctgcaccatctgtcttcatcttccgccatctgaatcacgtgtactgagcgggctggcaaggcgcatagnnnnnnnnn

SEQ ID NO: 61315 - DNA, 361 bp, Homo sapiens
  misc_feature: GYAE6OF02JB677.34.75.G09.1.454.CMB.1.raw
  modified_base (347)..(347): a, c, t, g, unknown or other
  misc_feature (347)..(347): n is a, c, g, or t
  modified_base (353)..(361): a, c, t, g, unknown or other
  misc_feature (353)..(361): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcgaggaccaaggtgagatcaaacgaactgtggctgcacatctgtcttcatcttcccgcatctgaatcacgtgtactgagcggctggcaaggcncatagnnnnnnnnn

SEQ ID NO: 61316 - DNA, 364 bp, Homo sapiens
  misc_feature: GYAE6OF02HRO2Q.34.75.G09.1.454.CMB.1.raw
  modified_base (354)..(364): a, c, t, g, unknown or other
  misc_feature (354)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggaggaccaaggtggagatcaaacgaactgtggctgcacatctgtcttcatctccgcatctgaatcacgtgtactgagcgggctggcaaggcgcatagnnnnnnnnnnn

SEQ ID NO: 61317 - DNA, 363 bp, Homo sapiens
  misc_feature: GYAE6OF02GJCBK.34.75.G09.1.454.CMB.1.raw
  modified_base (357)..(363): a, c, t, g, unknown or other
  misc_feature (357)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcagtctaataagtggccgtggacgttcggccaagggaccaaggtggaaatcaaaacgactgtggctgcaccatctgtcttcatcttccgccatctgaatcacgtgtactgagcggctggcaaggcgcatagnnnnnnn

SEQ ID NO: 61318 - DNA, 384 bp, Homo sapiens
  misc_feature: GYAE6OF02JAQLZ.34.75.G09.1.454.CMB.1.raw
  modified_base (317)..(317): a, c, t, g, unknown or other
  misc_feature (317)..(317): n is a, c, g, or t
  modified_base (368)..(368): a, c, t, g, unknown or other
  misc_feature (368)..(368): n is a, c, g, or t
  modified_base (375)..(384): a, c, t, g, unknown or other
  misc_feature (375)..(384): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcaggcgggtctgggacagatttcactctcaccatcaccagcctgcagcctgaagatgtggctagtttattactgtcagacaatattatagtccctccgctctacgtttcggacggtagggaccaagggtggagtatacaaaacgactgtggctgcaccatctgtcttnacttcctcccgcatctagaactcacgtgtactgaggcggctggacaaggcncagtagnnnnnnnnnn

SEQ ID NO: 61319 - DNA, 361 bp, Homo sapiens
  misc_feature: GYAE6OF02FFZF4.34.75.G09.1.454.CMB.1.raw
  modified_base (352)..(361): a, c, t, g, unknown or other
  misc_feature (352)..(361): n is a, c, g, or t
tcagtacacgtgatcacgaccggtgctcgatttagtatagacatcagggactacttagcttggttccagcagaaaccaggacagcctcctaagttgctcatttcctgggcatctacccggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtggagatcaaacgactgtggctgcaccatctgtcttcatcttccgcatctgatcacgtgtactgagcgggctggcaaggcgcatagnnnnnnnnnn

SEQ ID NO: 61320 - DNA, 361 bp, Homo sapiens
  misc_feature: GYAE6OF02F6VW9.34.75.G09.1.454.CMB.1.raw
  modified_base (356)..(361): a, c, t, g, unknown or other
  misc_feature (356)..(361): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtggagatcaaacgaactgtggctgcaccatctgtcttcatccttccgcatctgaatcacgtgtactgagcgggctggcaaggcgcatagnnnnnn

SEQ ID NO: 61321 - DNA, 372 bp, Homo sapiens
  misc_feature: GYAE6OF02GJA4S.34.75.G09.1.454.CMB.1.raw
  modified_base (361)..(372): a, c, t, g, unknown or other
  misc_feature (361)..(372): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcggaggaccaaggtggagatcaaacgactgtggctgcacatctgtcttcatccttccgcctatctgaatcacgtgtactgacgcgggctggacaaggcgacaagtagnnnnnnnnnnnn

SEQ ID NO: 61322 - DNA, 372 bp, Homo sapiens
  misc_feature: GYAE6OF02HS64A.34.75.G09.1.454.CMB.1.raw
  modified_base (327)..(327): a, c, t, g, unknown or other
  misc_feature (327)..(327): n is a, c, g, or t
  modified_base (355)..(357): a, c, t, g, unknown or other
  misc_feature (355)..(357): n is a, c, g, or t
  modified_base (359)..(372): a, c, t, g, unknown or other
  misc_feature (359)..(372): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggagggaccaaggtgagatcaaacgatgtggctgcaccatctgtctcatccttcccgcatctgactcacgtntactgaggcggctggcaagggcacagtnnncnnnnnnnnnnnnnn

SEQ ID NO: 61323 - DNA, 417 bp, Homo sapiens
  misc_feature: GYAE6OF02I72AC.34.75.G09.1.454.CMB.1.raw
  modified_base (394)..(417): a, c, t, g, unknown or other
  misc_feature (394)..(417): n is a, c, g, or t
tcagtacacgtgatcacgaccggtgctcgatttagtatagacatcagggactacttagcttggttccagcagaaaccaggacagcctcctaagttgctcatttactgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggagggaccaaggtggagatcaaacgaactgtgctgccacatcgtgttcctactacttcctcccgctactctagtactacgtacggtacgttacgaggtacgggccgggttcgtcggaacggaacggtcgactaagtagnnnnnnnnnnnnnnnnnnnnnnnn

SEQ ID NO: 61324 - DNA, 356 bp, Homo sapiens
  misc_feature: GYAE6OF02I2OAZ.34.75.G09.1.454.CMB.1.raw
  modified_base (350)..(356): a, c, t, g, unknown or other
  misc_feature (350)..(356): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctcgctcactttcggcgaggaccaaggtgagatcaaacgactgtggctgcaccatctgtcttcatcctccgcatctgaatcacgtgtactgagcgggctggcaaggcgcatgnnnnnnn

SEQ ID NO: 61325 - DNA, 369 bp, Homo sapiens
  misc_feature: GYAE6OF02HFVSV.34.75.G09.1.454.CMB.1.raw
  modified_base (359)..(369): a, c, t, g, unknown or other
  misc_feature (359)..(369): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagttttattactgtcagcaatattatagtcctccgctcactttcggcggagggaccaaggtggagatcaaacgactgtggctgcaccatctgtcttcatccttcccgcatctgaatcacgtgtactgagcgggctggcaaggcgcatagnnnnnnnnnnn

SEQ ID NO: 61326 - DNA, 358 bp, Homo sapiens
  misc_feature: GYAE6OF02IAUJZ.34.75.G09.1.454.CMB.1.raw
  modified_base (345)..(345): a, c, t, g, unknown or other
  misc_feature (345)..(345): n is a, c, g, or t
  modified_base (350)..(358): a, c, t, g, unknown or other
  misc_feature (350)..(358): n is a, c, g, or t
tcagtacacgtgatcacgaccggtgctcgatttagtatagacatcagggactacttagcttggttccagcagaaaccaggacagcctcctaagttgctcattcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcggaggaccaaggtggagatcaaacgaactgtgctgcacatctgtcttcatcttccgcatctgaatcacgtgtactgagcggctggcaaggcnatagnnnnnnnnn

SEQ ID NO: 61327 - DNA, 379 bp, Homo sapiens
  misc_feature: GYAE6OF02IR77G.34.75.G09.1.454.CMB.1.raw
  modified_base (222)..(222): a, c, t, g, unknown or other
  misc_feature (222)..(222): n is a, c, g, or t
  modified_base (357)..(359): a, c, t, g, unknown or other
  misc_feature (357)..(359): n is a, c, g, or t
  modified_base (361)..(379): a, c, t, g, unknown or other
  misc_feature (361)..(379): n is a, c, g, or t
tcagtacacgtgatcacgaccggtgctcgatttagtatagacatcaggggactacttagcttgggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattacngtcagcaatattatagtcctccgctcactttcggcgaggaccaaggtggagatcaaacgactgtaggctgcacatctgtcttcatctcccgcatctgaatcacgtgtactgacgcgggctggcaagggcacatgnnnannnnnnnnnnnnnnnnnnn

SEQ ID NO: 61328 - DNA, 381 bp, Homo sapiens
  misc_feature: GYAE6OF02HX63X.34.75.G09.1.454.CMB.1.raw
  modified_base (310)..(310): a, c, t, g, unknown or other
  misc_feature (310)..(310): n is a, c, g, or t
  modified_base (367)..(381): a, c, t, g, unknown or other
  misc_feature (367)..(381): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatacgtcctccgctcactttcggcggagggaccaaaggtggagatacaaaacgaactgtggctgcaccatctgtcttnatcttcccgcatctagactcacgtgtactgagcgggactggcaaagggcgacatagnnnnnnnnnnnnnnn

SEQ ID NO: 61329 - DNA, 363 bp, Homo sapiens
  misc_feature: GYAE6OF02I9HZD.34.75.G09.1.454.CMB.1.raw
  modified_base (356)..(363): a, c, t, g, unknown or other
  misc_feature (356)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtggagatcaaacgaactgtggctgcaccatctgtctcatcttccgccatcctgaatcacgtgtactgagcgggctggcaaggcgcatagnnnnnnnn

SEQ ID NO: 61330 - DNA, 363 bp, Homo sapiens
  misc_feature: GYAE6OF02FW4J5.34.75.G09.1.454.CMB.1.raw
  modified_base (355)..(363): a, c, t, g, unknown or other
  misc_feature (355)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtgagatcaaacgaactgtggctgcaccatctgtcttcatcttcccgcatctgaatcacgtgtactgagcgggctggcaaggcacatagnnnnnnnnn

SEQ ID NO: 61331 - DNA, 364 bp, Homo sapiens
  misc_feature: GYAE6OF02IGR5C.34.75.G09.1.454.CMB.1.raw
  modified_base (320)..(320): a, c, t, g, unknown or other
  misc_feature (320)..(320): n is a, c, g, or t
  modified_base (356)..(364): a, c, t, g, unknown or other
  misc_feature (356)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagttttatactgtcagcaatattatagtcctccgctcactttcggcggaggaccaaggtggagatcaaaacgactgtggctgcaccatctgtcttcatccttcccgcatcngaatcacgtgactgagcggctggcaaggcacatagnnnnnnnnn

SEQ ID NO: 61332 - DNA, 363 bp, Homo sapiens
  misc_feature: GYAE6OF02I43AG.34.75.G09.1.454.CMB.1.raw
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (353)..(363): a, c, t, g, unknown or other
  misc_feature (353)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagttttatactgtcagcaatattatagtccctcgctcactttcggcggaggaccaaggtggagatcaaacgaactgtggctgcaccatctgtctcatctccgcatctgaatcacgtntactgagcggctggcaggcncatagnnnnnnnnnnn

SEQ ID NO: 61333 - DNA, 468 bp, Homo sapiens
  misc_feature: GYAE6OF02FJJZB.34.75.G09.1.454.CMB.1.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (435)..(468): a, c, t, g, unknown or other
  misc_feature (435)..(468): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcggtctgggacagatttcactctcaccatccaccagccctgccagcctgaaagntgtggctaagtttataccgtgtcagtccaattacttacgtaccgttccctcccgtcctcctaaccggtttcggggcgtaacgggaccccaaggttcgggaanacttaccgaaaccggtaaccgtggtcggcctnccacctactntcgttctcatcccttcccgactntcgtagaatccgacgtgtaacctggacgtcgggctcggcgaacggtcgactacgagntnacnnnnnnnnnnnnnnnnnnnnnnnnnnnnnnnnnn

SEQ ID NO: 61334 - DNA, 372 bp, Homo sapiens
  misc_feature: GYAE6OF02IKLQC.34.75.G09.1.454.CMB.1.raw
  modified_base (303)..(303): a, c, t, g, unknown or other
  misc_feature (303)..(303): n is a, c, g, or t
  modified_base (357)..(372): a, c, t, g, unknown or other
  misc_feature (357)..(372): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatacgtcctccgatcactttcggcggagggaccaaggtggagatcaaacgactgtgctgcacatctgtcttnatctccgcatctgaatcaacgtgtacctgaggcggctggacaagggctcatagnnnnnnnnnnnnnnnn

SEQ ID NO: 61335 - DNA, 365 bp, Homo sapiens
  misc_feature: GYAE6OF02FWOUS.34.75.G09.1.454.CMB.1.raw
  modified_base (357)..(365): a, c, t, g, unknown or other
  misc_feature (357)..(365): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatggtggcagtttattactgtcagcaatattatagtcctcgctcactttcggcggaggaccaaggtggagatcaaacgactgtggctgcaccatctgtcttcatcttcccgccatctgaatcacgtgtactgagcgggctggcaaggcgcatagnnnnnnnnn

SEQ ID NO: 61336 - DNA, 389 bp, Homo sapiens
  misc_feature: GYAE6OF02JM3SS.34.75.G09.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (374)..(377): a, c, t, g, unknown or other
  misc_feature (374)..(377): n is a, c, g, or t
  modified_base (380)..(389): a, c, t, g, unknown or other
  misc_feature (380)..(389): n is a, c, g, or t
tcagtacacgtgatcacgaccggtgctcgatttagtatagacatcaggactacttagcttggttcctagcagaaaccaggacagcctcctaagttgctcattcctgggcatctacccggaatccggggtccctgaccgattcagtggctagcgggtctgggacaggatttcactctcaccatcaccagcctgcagccctgaacgatggtggcagttttatacngttcancagtatanaactggcctcggggattcggcaggcagngatcaagactgngntgcaccatctntcctntactactcccgtacatctagaatcacgtgtactgagcggtcgacgtgaaggttccgnacgttanggtacntacgncntnnnntannnnnnnnnn

SEQ ID NO: 61337 - DNA, 367 bp, Homo sapiens
  misc_feature: GYAE6OF02H9NSS.34.75.G09.1.454.CMB.1.raw
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (357)..(367): a, c, t, g, unknown or other
  misc_feature (357)..(367): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtcctgaccgattcagtggcagcgggtctgggacagatttcactctcaccatcaccagcctgcagcctgaagatgtggcagtttatactgtcagcaaattattatagtcctccgctcactttcggcgagggaccaaggtggagatcaaaacgaactgtggctgcaccatctgtctnatcttccgccatcngaatcacgtntactgagcggctggcaaggcgacntagnnnnnnnnnnn

SEQ ID NO: 61338 - DNA, 363 bp, Homo sapiens
  misc_feature: GYAE6OF02GCB96.34.75.G09.1.454.CMB.1.raw
  modified_base (242)..(242): a, c, t, g, unknown or other
  misc_feature (242)..(242): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (354)..(363): a, c, t, g, unknown or other
  misc_feature (354)..(363): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatatatagtcctccgntcactttcggcggaggaccaaggtggagatcaaacgactgtggctgcaccatctgtcttcatccttccgcatctgaatcacgtgtactgagcgggntggcaaggcncatagnnnnnnnnnn

SEQ ID NO: 61339 - DNA, 360 bp, Homo sapiens
  misc_feature: GYAE6OF02FRE3R.34.75.G09.1.454.CMB.1.raw
  modified_base (353)..(360): a, c, t, g, unknown or other
  misc_feature (353)..(360): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggaggaccaaggtggagatcaaacgactgtggctgcacatctgtcttcatcttcccgcatctgaactcacgtgtactgagcggctggacaggcgcatgnnnnnnnn

SEQ ID NO: 61340 - DNA, 377 bp, Homo sapiens
  misc_feature: GYAE6OF02HT4QR.34.75.G09.1.454.CMB.1.raw
  modified_base (235)..(235): a, c, t, g, unknown or other
  misc_feature (235)..(235): n is a, c, g, or t
  modified_base (357)..(377): a, c, t, g, unknown or other
  misc_feature (357)..(377): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagttttattactgtcagcaatattanagtcctccgctcactttcggcggagggaccaaggtggagatcaaaacgactgtggctgcacatctgtcttcatcttcccgcatctgaatcagtgtactgagcggctggcaaggcgacatagnnnnnnnnnnnnnnnnnnnnn

SEQ ID NO: 61341 - DNA, 498 bp, Homo sapiens
  misc_feature: GYAE6OF02IPIF2.34.75.G09.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (464)..(498): a, c, t, g, unknown or other
  misc_feature (464)..(498): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtcctgaccgattcagtggcagcgggtctggggacagatttcgactctcaccatcaccagcctgnagcctgaagatgtggctagtttattacngtcagcaatattatagtccctcgctctacttcggcggagggtaccaaggtggagacttacgaaaacgtaactggttacggcttcggaccaaccaagttccgttaggttacctttaccgtaactttcccgttttccccggcccctaaatttccgtacgtaaaacgtttcctaaccgggttattaaccgtggaacgggcccgggggtaacttcggggacaagggtccggctaaaggttgagctnnnnnnnnnnnnnnnnnnnnnnnnnnnnnnnnnnn

SEQ ID NO: 61342 - DNA, 415 bp, Homo sapiens
  misc_feature: GYAE6OF02GM4OX.34.75.G09.1.454.CMB.1.raw
  modified_base (205)..(205): a, c, t, g, unknown or other
  misc_feature (205)..(205): n is a, c, g, or t
  modified_base (368)..(368): a, c, t, g, unknown or other
  misc_feature (368)..(368): n is a, c, g, or t
  modified_base (389)..(391): a, c, t, g, unknown or other
  misc_feature (389)..(391): n is a, c, g, or t
  modified_base (393)..(395): a, c, t, g, unknown or other
  misc_feature (393)..(395): n is a, c, g, or t
  modified_base (397)..(415): a, c, t, g, unknown or other
  misc_feature (397)..(415): n is a, c, g, or t
tcagtacacgtgatcacgaccggtgctcgatttagtatagacatcagggactacttagcttggttccagcagaaaccaggacagcctcctaagttgctcatttcctgggacatctacccgggaatccggggtccctgaccgattcagtggcagcgggtctagggacagatttcactctcaccatcaccagcctgcagcctgaagntggtggctagtttatactgtcagcaatacttatacgtccctccgcttcaccgtttcggacggacgggaccaaggtgacgatacaaacgaactgtaggctgcacatcctgtccttcacttccgttaccgccatccgtgaactcgacgttgtactggacgcgggntggacaaggcgacatagcatnnncnnngnnnnnnnnnnnnnnnnnnn

SEQ ID NO: 61343 - DNA, 365 bp, Homo sapiens
  misc_feature: GYAE6OF02GB2YM.34.75.G09.1.454.CMB.1.raw
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (358)..(365): a, c, t, g, unknown or other
  misc_feature (358)..(365): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctccgctcactttcggcggagggaccaaggtggagatacaaacgactggtggctgcaccatctgtcttcatcttccgcatctgatcagtgtactgacgcgggtntggacaaggcncatgnnnnnnnn

SEQ ID NO: 61344 - DNA, 391 bp, Homo sapiens
  misc_feature: GYAE6OF02I3G71.34.75.G09.1.454.CMB.1.raw
  modified_base (338)..(338): a, c, t, g, unknown or other
  misc_feature (338)..(338): n is a, c, g, or t
  modified_base (365)..(391): a, c, t, g, unknown or other
  misc_feature (365)..(391): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttattactgtcagacaatattatagtcctccgctctacttcggcggagggaccaaggtgagatacaaacgactgtgactgcacatctgtctcatctcccgcatctagactcacgtgtactgacgnggtcgtcggacgaaggcgtacagtagnnnnnnnnnnnnnnnnnnnnnnnnnnn

SEQ ID NO: 61345 - DNA, 376 bp, Homo sapiens
  misc_feature: GYAE6OF02F5SWR.34.75.G09.1.454.CMB.1.raw
  modified_base (345)..(345): a, c, t, g, unknown or other
  misc_feature (345)..(345): n is a, c, g, or t
  modified_base (361)..(376): a, c, t, g, unknown or other
  misc_feature (361)..(376): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcggaggaccaaggtggagatacaaaacgaactgtggctgcacatctgtcttcactcttcccgcatctagaactcacgtgtactgaggcgggntggcaaggcgcatagnnnnnnnnnnnnnnnn

SEQ ID NO: 61346 - DNA, 394 bp, Homo sapiens
  misc_feature: GYAE6OF02HVUVZ.34.75.G09.1.454.CMB.1.raw
  modified_base (373)..(394): a, c, t, g, unknown or other
  misc_feature (373)..(394): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagttttattactgtcagcaatatcgagacgcactggtgggcgttcggaccgaagggaccaagggtggaaaatcaaacgaatgtggctgcaccatctgtcttcattcctccgcatctgaatcacgtgtactggacgcgggctggacaaggccgatagtagcagnnnnnnnnnnnnnnnnnnnnnn

SEQ ID NO: 61347 - DNA, 406 bp, Homo sapiens
  misc_feature: GYAE6OF02FLQE0.34.75.G09.1.454.CMB.1.raw
  modified_base (366)..(367): a, c, t, g, unknown or other
  misc_feature (366)..(367): n is a, c, g, or t
  modified_base (369)..(406): a, c, t, g, unknown or other
  misc_feature (369)..(406): n is a, c, g, or t
tcagtacacgtgatcacgaccggtgctcgatttagtatagacatcaggggtacgtacttagcttggttccagcagaaaccaggacagcctcctaacgttgctcatttcctgggcatctaccgggaatccggggtccctgaccgattcagtggcagcgggtctgggacagatttcactctcaccatcaccagcctgcagcctgaagatgtggcagtttatactgtcagcaatatatagtcctacgctcactttcggcggtagggaccaaggtggagatcaaacgaacgtgtggctgcaccatctgtcttcatcttccgcatctgaactcacgtgtactgagcgggctcggcgtaaggcgacatagtnntnnnnnnnnnnnnnnnnnnnnnnnnnnnnnnnnnnnnnn

SEQ ID NO: 61348 - DNA, 386 bp, Homo sapiens
  misc_feature: GYAE6OF02IBGAJ.34.75.G09.1.454.CMB.1.raw
  modified_base (246)..(246): a, c, t, g, unknown or other
  misc_feature (246)..(246): n is a, c, g, or t
  modified_base (369)..(386): a, c, t, g, unknown or other
  misc_feature (369)..(386): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagttttattactgtcagcaaatattatagtcctccgntcacgttttcggcggtaggaccaaggtggagatcaaaacgactgtggctgcaccatctgtcttcatcttcccgctatctagaactcacgtactactgaggcggctggacaaggcgacagtagnnnnnnnnnnnnnnnnnn

SEQ ID NO: 61349 - DNA, 426 bp, Homo sapiens
  misc_feature: GYAE6OF02J0DGG.34.75.G09.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (408)..(426): a, c, t, g, unknown or other
  misc_feature (408)..(426): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgacccgattcagtggcaggcgggtctgggacaggatttcactctcgaccatcaccaggcctgccagtcctgaagntggtcgcagttttatacngtcagcaatagttanagtccctcgatcacgtttgcgacggaccaggtgganacgtacaaaccgaagtggtcggnttgaccacgatctgtcctacgtactccttaccccgctatccgtataacttacgaccgttgttacnggacgcgggtctggacgtacggcncagttaagcaggtcnannnnnnnnnnnnnnnnnnn

SEQ ID NO: 61350 - DNA, 382 bp, Homo sapiens
  misc_feature: GYAE6OF02I7N6E.34.75.G09.1.454.CMB.1.raw
  modified_base (203)..(203): a, c, t, g, unknown or other
  misc_feature (203)..(203): n is a, c, g, or t
  modified_base (369)..(382): a, c, t, g, unknown or other
  misc_feature (369)..(382): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagntgtggctagtttattactgtcagcaatattatagtccctccgctcactttcggcggagggaccaaggtggagatacaaacgaactgtggctgcaccatctgtcttcattccttcccgctatctagactcacgtgtactgaggcgggtctggcaaggcgacagtagnnnnnnnnnnnnnn

SEQ ID NO: 61351 - DNA, 432 bp, Homo sapiens
  misc_feature: GYAE6OF02I0RGV.34.75.G09.1.454.CMB.1.raw
  modified_base (105)..(105): a, c, t, g, unknown or other
  misc_feature (105)..(105): n is a, c, g, or t
  modified_base (156)..(156): a, c, t, g, unknown or other
  misc_feature (156)..(156): n is a, c, g, or t
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (414)..(432): a, c, t, g, unknown or other
  misc_feature (414)..(432): n is a, c, g, or t
tcagtacacgtgatcacgaccggtgctcgatttagtatagacatcagggactacttagcttggttccagcagaaaccaggacagcctctaagttgctcatttccnggcatctacccgggaatccggggtccctgaccgattcagtgcagcgggtcngggacagatttcactctcaccatcaccngcctgcancctgaagntggtagctagtttatactgtcaagctaattacttatcgtccctaccgctcaaccgtttcggaccggacggaacctacggtagggaacgacttacgaaaacgtacgtggtacggctcggacaaccgtctcgttcgtacctactaacttccgtcccgcaagttctagaacctcgccgttaagcgtagcggtcggctcgggacaggactcgaagtgnnnnnnnnnnnnnnnnnnn

SEQ ID NO: 61352 - DNA, 401 bp, Homo sapiens
  misc_feature: GYAE6OF02JSUNP.34.75.G09.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (375)..(401): a, c, t, g, unknown or other
  misc_feature (375)..(401): n is a, c, g, or t
tcagtacacgtgatcacgaccggtgctcgatttagtatagacatcaggggactacttagcttggttccagcagaaacccaggacagcctcctaagttgctcatttcctgggcatctacccgggaatccggggtccctgaccgattcagtggcagcgggtctgggacagatttcactctcaccatcaccagcctncagcctgaagatgtggcagtttatacngtcagcaatattatagtcctaccgctcacctttcggcggtaggaccaaggtggaagatacgaaagactgtggctgcaacntctntcttcatccttcccgctaatctagaacttcacgttgtactgagccgggctggacaacggcgtcaatagcnnnnnnnnnnnnnnnnnnnnnnnnnnn

SEQ ID NO: 61353 - DNA, 364 bp, Homo sapiens
  misc_feature: GYAE6OF02F0ZFM.34.75.G09.1.454.CMB.1.raw
  modified_base (355)..(364): a, c, t, g, unknown or other
  misc_feature (355)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagacttcactctcaccatcaccagactggagcctgaagattttgcagtgtattactgtcaacagttggtctcacacacgtggacgttcggccaaggaccaaggtggaaatcaaacgaactgtggctgcaccatctgtcttcatcttcccgcatctgaatcagtgtactgagcggctggcaaggcgcatagnnnnnnnnnn

SEQ ID NO: 61354 - DNA, 367 bp, Homo sapiens
  misc_feature: GYAE6OF02GDEC4.34.75.G09.1.454.CMB.1.raw
  modified_base (352)..(352): a, c, t, g, unknown or other
  misc_feature (352)..(352): n is a, c, g, or t
  modified_base (358)..(359): a, c, t, g, unknown or other
  misc_feature (358)..(359): n is a, c, g, or t
  modified_base (361)..(367): a, c, t, g, unknown or other
  misc_feature (361)..(367): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggctagtttattactgtcagcaatattatagtcctccgctcactttcggcggaggaccaaggtggagatcaaacgactgtggctgcaccatctgtcttcatccttccgctatctgaatcacgtgtactgagcgggctggacaggcncatagnngnnnnnnn

SEQ ID NO: 61355 - DNA, 378 bp, Homo sapiens
  misc_feature: GYAE6OF02HH66Q.34.75.G09.1.454.CMB.1.raw
  modified_base (203)..(203): a, c, t, g, unknown or other
  misc_feature (203)..(203): n is a, c, g, or t
  modified_base (340)..(340): a, c, t, g, unknown or other
  misc_feature (340)..(340): n is a, c, g, or t
  modified_base (364)..(378): a, c, t, g, unknown or other
  misc_feature (364)..(378): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagntgtggcagttttatactgtcagacaatattatacgtcctccgctcacgtttcggcggagggaccaaggtgagatcaaacgactgtgctgcaccatctgtcttcattccttcccgctagtctagaatcacgtgtacgngagcggctggacaaggcacatcgnnnnnnnnnnnnnnn

SEQ ID NO: 61356 - DNA, 396 bp, Homo sapiens
  misc_feature: GYAE6OF02JGJ70.34.75.G09.1.454.CMB.1.raw
  modified_base (339)..(339): a, c, t, g, unknown or other
  misc_feature (339)..(339): n is a, c, g, or t
  modified_base (373)..(396): a, c, t, g, unknown or other
  misc_feature (373)..(396): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagccttcagcctgaagatgtggctagtttattactgtcagctaatattatacgtctccgtctctacgtttcggacggtaggaccaaggtggagatacaaacgaactggtggctgcacctatctgtctcatcctccgctatctagaatcacgtntactgacggcggcgtggcaacggcgacagtacgnnnnnnnnnnnnnnnnnnnnnnnn

SEQ ID NO: 61357 - DNA, 364 bp, Homo sapiens
  misc_feature: GYAE6OF02FZLLS.34.75.G09.1.454.CMB.1.raw
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (356)..(364): a, c, t, g, unknown or other
  misc_feature (356)..(364): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagttttattactgtcagcaatattatagtcctcgctctacgtttcggcggagggaccaaggtggagatcaaacgactgtgctgcacntctgtctcntccttccgcctatctgaatcacgtgtactgagcggctggcaaggcncangnnnnnnnnn

SEQ ID NO: 61358 - DNA, 415 bp, Homo sapiens
  misc_feature: GYAE6OF02H5ANX.34.75.G09.1.454.CMB.1.raw
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (385)..(385): a, c, t, g, unknown or other
  misc_feature (385)..(385): n is a, c, g, or t
  modified_base (389)..(415): a, c, t, g, unknown or other
  misc_feature (389)..(415): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaanatgtggctagtttattactntcagcaattattanacgtcctccgnttcactttcggcgaggaccaaggtgagatacaaacgtactggtaggctgcacatctgtcttcactctcccgactatcgtagtaatccgttagtacgttgcggccgggtcttaggaccgaacgggcgacctaagtcgangtcnnnnnnnnnnnnnnnnnnnnnnnnnnn

SEQ ID NO: 61359 - DNA, 596 bp, Homo sapiens
  misc_feature: GYAE6OF02JYB37.34.75.G09.1.454.CMB.1.raw
  modified_base (167)..(167): a, c, t, g, unknown or other
  misc_feature (167)..(167): n is a, c, g, or t
  modified_base (363)..(363): a, c, t, g, unknown or other
  misc_feature (363)..(363): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(596): a, c, t, g, unknown or other
  misc_feature (561)..(596): n is a, c, g, or t
tcagtacacgtgatcacgaccggtgctcgatttagtatagacatcagggactacttagcttggttccagcagaaaccaggacaagcctcctaagttgctcatttcctgggcagtctacccgggaatccggggtccctgaccgattcagtggcagcgggtctgggacnggatttcactctcaccagtccaccgagcccttggccaagcccgtagaagactggtggcctaaggtttattaccgtgtccagacctaaattatttaatcggtttccccctaccggctttccaaaccgtttttccgggaccggaacggggtaaccccaaggggttcggaagtaacgtaccgaaaacggtaaccgtagngggtacctggacacccgtatacctgtacttcgaacttcctccccgtcaacttcgtactaacgttccaacggtttactaccgtaggaacggtccgggggtacttacggggccgttaaaacggggcccgggtacaaccggtttaagggacctgggtcgtaaaagttcaaggtcctggcgcgcgntcgnanctcgngangnnnnnnnnnnnnnnnnnnnnnnnnnnnnnnnnnnnn

SEQ ID NO: 61360 - DNA, 435 bp, Homo sapiens
  misc_feature: GYAE6OF02IJAZO.34.75.G09.1.454.CMB.1.raw
  modified_base (167)..(167): a, c, t, g, unknown or other
  misc_feature (167)..(167): n is a, c, g, or t
  modified_base (209)..(209): a, c, t, g, unknown or other
  misc_feature (209)..(209): n is a, c, g, or t
  modified_base (311)..(311): a, c, t, g, unknown or other
  misc_feature (311)..(311): n is a, c, g, or t
  modified_base (403)..(435): a, c, t, g, unknown or other
  misc_feature (403)..(435): n is a, c, g, or t
tcagtacacgtgatcacgaccggtgctcgatttagtatagacatcagggactacttagcttggttccagcagaaaccaggacagccctcctaagttgctcatttcctgggcatctacccgggaatccggggtccctgaccgattcagtggcaggcgggtctgggacngatttcactctcaccatccaccagcctgcagcctgaagatgnggctagttttatactgtcaagctaaattagttataccgtcctccgctctacgtttcggcgggacgggacaagggtcgagtatacaaacgactgtgctcgacncatctgtcttcacttccttcccgctactctaagtactcgtacgtgtaactggacggcgggtacgtcggacgaacgggtcaagtactgctcgnnnnnnnnnnnnnnnnnnnnnnnnnnnnnnnnn

SEQ ID NO: 61361 - DNA, 405 bp, Homo sapiens
  misc_feature: GYAE6OF02GR1OS.34.75.G09.1.454.CMB.1.raw
  modified_base (381)..(405): a, c, t, g, unknown or other
  misc_feature (381)..(405): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggacagtttatactgtcagcaatattatacgtcctccgctctactttcgggcggagggaccaagggtggagatacaaacgactgtggctgcacatctgtcttcacttctcccgctatctagaacttcaccgttgtactcggacggcggggtctggaccgtaagggcgacagtagnnnnnnnnnnnnnnnnnnnnnnnnn

SEQ ID NO: 61362 - DNA, 457 bp, Homo sapiens
  misc_feature: GYAE6OF02FG4Y1.34.75.G09.1.454.CMB.1.raw
  modified_base (176)..(176): a, c, t, g, unknown or other
  misc_feature (176)..(176): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(457): a, c, t, g, unknown or other
  misc_feature (414)..(457): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactcncaccatcaccagcctggacagccctgaagctgtcggctagtttattacctgtacagactaatattatacgtcctccgctactacgttcgggcggaagggaccaggtcggagacttaacgaaacgtaacttggtcggctcgacctaccattcctagttccttcaactttccttcccgcactcgtaagactcgagtntacnggacgcgggctaggacgtacggcncgaatntcgangncnnnnnnnnnnnnnnnnnnnnnnnnnnnnnnnnnnnnnnnnnnnn

SEQ ID NO: 61363 - DNA, 422 bp, Homo sapiens
  misc_feature: GYAE6OF02HIT2W.34.75.G09.1.454.CMB.1.raw
  modified_base (233)..(233): a, c, t, g, unknown or other
  misc_feature (233)..(233): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (383)..(422): a, c, t, g, unknown or other
  misc_feature (383)..(422): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattanacgtcctccgctcactttcggcggaggaccaaggtcggagatacaaaacgactgtaggctgcaccattctgtctcattccttcccgacatctagaactcacgttgtacgngacggcgggtctcggacgaacggtcgactataaggncngnnnnnnnnnnnnnnnnnnnnnnnnnnnnnnnnnnnnnnnn

SEQ ID NO: 61364 - DNA, 506 bp, Homo sapiens
  misc_feature: GYAE6OF02H2ZVO.34.75.G09.1.454.CMB.1.raw
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (453)..(454): a, c, t, g, unknown or other
  misc_feature (453)..(454): n is a, c, g, or t
  modified_base (457)..(457): a, c, t, g, unknown or other
  misc_feature (457)..(457): n is a, c, g, or t
  modified_base (459)..(463): a, c, t, g, unknown or other
  misc_feature (459)..(463): n is a, c, g, or t
  modified_base (465)..(468): a, c, t, g, unknown or other
  misc_feature (465)..(468): n is a, c, g, or t
  modified_base (470)..(471): a, c, t, g, unknown or other
  misc_feature (470)..(471): n is a, c, g, or t
  modified_base (473)..(491): a, c, t, g, unknown or other
  misc_feature (473)..(491): n is a, c, g, or t
  modified_base (493)..(506): a, c, t, g, unknown or other
  misc_feature (493)..(506): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtgcagcgggtctgggacagatttcactctcaccatcaccagcctgcagcctgaagatgtggctagttttattactgtcagtctaattattatacgtcctccgctctacgtttcgggacggagggacctaaagggtcggagtactaccaaaacgtactggtggcctagcctaccattccgtgttcttccactttcccttcccccgactattccgtagtaaacttccgtaaccggttgtaaccgtgggacggtaccgggggtctacggggacctaaaggggtccgtacaagttacgcgtatanagcngnnctngnnnnngnnnnanngnnnnnnnnnnnnnnnnnnngnnnnnnnnnnnnnn

SEQ ID NO: 61365 - DNA, 373 bp, Homo sapiens
  misc_feature: GYAE6OF02G5PJQ.34.75.G09.1.454.CMB.1.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (361)..(362): a, c, t, g, unknown or other
  misc_feature (361)..(362): n is a, c, g, or t
  modified_base (364)..(373): a, c, t, g, unknown or other
  misc_feature (364)..(373): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctaccgctcactttcggcggagggaccaaggtggagatcaaaacgaactgtggctgcaccatctgtcttcatcttcccgctatctgaatcacgtntactgagcgggctggcaaggcanatagnngnnnnnnnnnn

SEQ ID NO: 61366 - DNA, 482 bp, Homo sapiens
  misc_feature: GYAE6OF02JQBPX.34.75.G09.1.454.CMB.1.raw
  modified_base (200)..(200): a, c, t, g, unknown or other
  misc_feature (200)..(200): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
  modified_base (459)..(482): a, c, t, g, unknown or other
  misc_feature (459)..(482): n is a, c, g, or t
tcagtacacgtgatcacgaccggtgctcgatttagtatagacatcagggactacttagcttggttccagcagaaaccaggacagcctcctaagttgctcattcctgggcatctaccgggatccggggtcctgaccgatcagtggcagcgggtctaggggacagatttcactctcaccagtcacagcctgcagcctgaagngtgtggctaggtttattctagtcagtcaaattattatacgttccctcgccttcaccgttttcggccggtaggggaccctaagggtagggaagtacgtacaaaacggtaacgtggttcggacgtcggactaaccccggattcctcgttcgtaccttagtcctttaccccgcttaatcccttagaacttccgaagtctactggacggtcggtactggaacggacggtcgaagtctaagngcgcttaagcagcatctngcannnnnnnnnnnnnnnnnnnnnnnn

SEQ ID NO: 61367 - DNA, 418 bp, Homo sapiens
  misc_feature: GYAE6OF02INWNR.34.75.G09.1.454.CMB.1.raw
  modified_base (200)..(200): a, c, t, g, unknown or other
  misc_feature (200)..(200): n is a, c, g, or t
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (381)..(383): a, c, t, g, unknown or other
  misc_feature (381)..(383): n is a, c, g, or t
  modified_base (388)..(418): a, c, t, g, unknown or other
  misc_feature (388)..(418): n is a, c, g, or t
tcagtacacgtgatcacgaccggtgctcgatttagtatagacatcagggactacttagcttggttccagcagaaaccaggacagcctcctaagttgctcatttcctggcatctacccgggaatccggggtcctgaccgattcagtggcagcgggtctgggacagatttcactctcacatcaccagcctgcagcctgaagnttgtggttatttattactgtcagactaattattatagtcctccgctctacgtttcggcgaaggccaagggtgacgatcaaaacgtactgtaggctgcacctatcgtgttcttccntccttcccgctatctagaacttcgaagttctacgngacgccgggntagcgtaagccgactagtacnnntgcannnnnnnnnnnnnnnnnnnnnnnnnnnnnnn

SEQ ID NO: 61368 - DNA, 716 bp, Homo sapiens
  misc_feature: GYAE6OF02IGTF4.34.75.G09.1.454.CMB.1.raw
  modified_base (106)..(106): a, c, t, g, unknown or other
  misc_feature (106)..(106): n is a, c, g, or t
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
  modified_base (566)..(566): a, c, t, g, unknown or other
  misc_feature (566)..(566): n is a, c, g, or t
tcagtacacgtgatcacgaccggtgctcgatttagtatagacatcgagggactacttagcttggttccagcagaaaccaggacagcctcctaagttgctcattccngggcatctacccggatccgggtcctgaccgattccagtggcaggcgggtctagggacagatttcacgtcctcaccatccacncgcctgcagcctgaagngtgtagccgtaagtttactacgtcgtacaacgtacaaattacttacgtaccggttccctccggtactttaccgttacggtttccgggaccgggtaacgggtaaaccgtagggtacggtaatactacgaaaacgtacgttggtacgcgtacggctaacccgatttccggtacttaccgtttacctaacttcccgttccccggtacctaaacgttcgtaacggttaactaccggttaacggttcggttaaaccgtcggtaaccggggtaccggggtttacgaccggtaaaccgggaaaccgggacccttaaagtaacgtcggctaggacgtactagctnaacggtncactgaacagtcgacgngtacgtacgtactactacgtacgacgtcgaccgtactacacactaacgtacgtacgtacgaaccgttacgtaacgtacgtacgacgtacgacgcgtacggtacggtaccgttacgtagacgttacggtcgtaccgtacgtccgtcgtacg

SEQ ID NO: 61369 - DNA, 601 bp, Homo sapiens
  misc_feature: GYAE6OF02GONK8.34.75.G09.1.454.CMB.1.raw
  modified_base (99)..(99): a, c, t, g, unknown or other
  misc_feature (99)..(99): n is a, c, g, or t
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (401)..(401): a, c, t, g, unknown or other
  misc_feature (401)..(401): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (522)..(522): a, c, t, g, unknown or other
  misc_feature (522)..(522): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(559): a, c, t, g, unknown or other
  misc_feature (558)..(559): n is a, c, g, or t
  modified_base (562)..(562): a, c, t, g, unknown or other
  misc_feature (562)..(562): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (577)..(578): a, c, t, g, unknown or other
  misc_feature (577)..(578): n is a, c, g, or t
  modified_base (582)..(582): a, c, t, g, unknown or other
  misc_feature (582)..(582): n is a, c, g, or t
  modified_base (591)..(593): a, c, t, g, unknown or other
  misc_feature (591)..(593): n is a, c, g, or t
  modified_base (595)..(595): a, c, t, g, unknown or other
  misc_feature (595)..(595): n is a, c, g, or t
  modified_base (599)..(599): a, c, t, g, unknown or other
  misc_feature (599)..(599): n is a, c, g, or t
tcagtacacgtgatcacgaccggtgctcgatttagtatagacatcagggactacttagcttggttccagcagaaaccaggacagcctcctaagttgctnattcctgggcatctaccggaatccggggtccctgaccattcagtggcagcggtntgggacagatttcactctcacagtcaccagtcctgcaacnccgtgaaagtcttaggnggacctagttttacttacngtctaagctaaatattgtacggtcccnccgtactcgtaacgttttcggacggacggggtaccaagggttgaaggtataccgtaaaacgagttcgtggccttaggacctacaacttctacggtttaccgttaacctacgtttcccttccccggtaccttaattccggtttaanaacttaccggtaaccggttcgttaacgttacggaacccgggggcggttcggtaaaccggaggttacccgggacttgggttaaacncggtacttagngtacgagttcnctcaaggtttccgntgtgcgctgtntncantctngtnacngngctntngnngtncgcactagtnctncnncgtntcgacgtcnnncntcgngc

SEQ ID NO: 61370 - DNA, 488 bp, Homo sapiens
  misc_feature: GYAE6OF02GPSK0.34.75.G09.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (460)..(488): a, c, t, g, unknown or other
  misc_feature (460)..(488): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgacccgattcaggtgcaggcggtctgggacagtactttcactcctcaccagtccaaccngcccttggacngccttagaaagctgtggactagttttatactgtcagntaaactattagtgtccctacggccttcaacgttttcgggacggaggaccctagggttggaanacgtacaaacggaacttggttggactggcccaacgtctcgtacgttacttctaacgtccgttccctactacgtcctaggaacctccgtaagtctacgtggacctcggggtacacggtaccgaacgggtcacgtaagngtacggnacggtngctagnnnnnnnnnnnnnnnnnnnnnnnnnnnnn

SEQ ID NO: 61371 - DNA, 495 bp, Homo sapiens
  misc_feature: GYAE6OF02JWXD3.34.75.G09.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (423)..(423): a, c, t, g, unknown or other
  misc_feature (423)..(423): n is a, c, g, or t
  modified_base (454)..(454): a, c, t, g, unknown or other
  misc_feature (454)..(454): n is a, c, g, or t
  modified_base (464)..(495): a, c, t, g, unknown or other
  misc_feature (464)..(495): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagntgtggactagtttattatgtcagccaaatnttatacgtcctccgactctacttcggacggaggggaccaagggtcggagtactaccaaaacgtacgtaggtcggtcgtaggtccaacccgtacgttcttacggttaccttacgtaaccttcccgttccccggcccttaactccgttacgaacgttcctacggtagttaaccgtcggtaacggccggggtnaccgggttacggacgacgacgtactaaggcngtccatgccnnnnnnnnnnnnnnnnnnnnnnnnnnnnnnnn

SEQ ID NO: 61372 - DNA, 425 bp, Homo sapiens
  misc_feature: GYAE6OF02H6DTI.34.75.G09.1.454.CMB.1.raw
  modified_base (205)..(205): a, c, t, g, unknown or other
  misc_feature (205)..(205): n is a, c, g, or t
  modified_base (355)..(355): a, c, t, g, unknown or other
  misc_feature (355)..(355): n is a, c, g, or t
  modified_base (404)..(425): a, c, t, g, unknown or other
  misc_feature (404)..(425): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctggggacagtatttcactctcaccatcaccagcctgcagcctgaagntgtggctagttttattactggtcagactaattattagtacgttccctccgcttctaacgttttcgggacggagggtaccaagggtggagatacgaaaacgaactgtggctcgccacccgattctgtcttcacttccttcccgcctatctnaactctacggtgtaactgacggcggtcgtcggacagggcgacagtacgnnnnnnnnnnnnnnnnnnnnnn

SEQ ID NO: 61373 - DNA, 413 bp, Homo sapiens
  misc_feature: GYAE6OF02GBKV2.34.75.G09.1.454.CMB.1.raw
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (364)..(413): a, c, t, g, unknown or other
  misc_feature (364)..(413): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttattactgtcagcaatattatagtcctcgctcactttcggcgaggaccaaggtggaagatcaaaacgactgtgctgcacatctgtcttcatcttcccgcatctgatcacgtgtactgagcggctggacaacggcgacaatagnacgatngnnnnnnnnnnnnnnnnnnnnnnnnnnnnnnnnnnnnnnnnnnnnnnnnnn

SEQ ID NO: 61374 - DNA, 473 bp, Homo sapiens
  misc_feature: GYAE6OF02FPGGY.34.75.G09.1.454.CMB.1.raw
  modified_base (414)..(414): a, c, t, g, unknown or other
  misc_feature (414)..(414): n is a, c, g, or t
  modified_base (439)..(439): a, c, t, g, unknown or other
  misc_feature (439)..(439): n is a, c, g, or t
  modified_base (451)..(473): a, c, t, g, unknown or other
  misc_feature (451)..(473): n is a, c, g, or t
tcagtacacgtgatcacgaccggtgctcgatttagtatagacatcagggactacttagcttggttccagcagaaaccaggacagcctcctaaagttgctcatttcctgggcatctacccgggaatccggggtccctgaccgattcagtggcagcggtctgggacagatttcactctcaccatcaccagcctgcagcctagaagatggtggctagttttattactgtcagactaaattagttatacgtccctccgctctacgtttcggacggaggaccaggtggaagacttacgaaaaacgacttggcggctcgaccaaccgtattccgttgttccttactacttccccgtttccccggacctgttcccgtaagtaaaccttccgaaacgttctaacgtggaccggtcggggtcnggtaacgacgggccgtaacaagtcncgaatgcaggtnnnnnnnnnnnnnnnnnnnnnnn

SEQ ID NO: 61375 - DNA, 688 bp, Homo sapiens
  misc_feature: GYAE6OF02GD06H.34.75.G09.1.454.CMB.1.raw
  modified_base (152)..(152): a, c, t, g, unknown or other
  misc_feature (152)..(152): n is a, c, g, or t
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (633)..(633): a, c, t, g, unknown or other
  misc_feature (633)..(633): n is a, c, g, or t
  modified_base (635)..(637): a, c, t, g, unknown or other
  misc_feature (635)..(637): n is a, c, g, or t
  modified_base (639)..(639): a, c, t, g, unknown or other
  misc_feature (639)..(639): n is a, c, g, or t
  modified_base (642)..(644): a, c, t, g, unknown or other
  misc_feature (642)..(644): n is a, c, g, or t
  modified_base (647)..(650): a, c, t, g, unknown or other
  misc_feature (647)..(650): n is a, c, g, or t
  modified_base (652)..(659): a, c, t, g, unknown or other
  misc_feature (652)..(659): n is a, c, g, or t
  modified_base (662)..(688): a, c, t, g, unknown or other
  misc_feature (662)..(688): n is a, c, g, or t
tcagtacacgtgatcacgaccggtgctcgatttagtatagacatcagggactacttagcttggttccagcagaaaccaggacagcctcctaagttgctcatttcctgggcatctacccgggatccggggtccctgaccgtattcagtggacnggtcgggtctgggacagtattttccactctcaaccagtccaccgaggcctgacgacgtccgtagtaacgtgttgggtaccgttagtttaacgttttaacgttaccgttacgtaacgaacggtaaacttaactttaaacttacggttacccggttaccccctttcccggtaacctttcccggttttaaccggggtttaccggggggacccgggggtaaacggggtaaacccggttaaaggggtaacgggtaacggtaaacgtaacccggtaaaacgttaaccggttcggggtacggtcccgtaacgggaaccttaccgtaacgtttccggttacggtttacccgttaccttaaccctttcccggtacctacgttaaccttaccggggtaactaaccggttacctttaacgggtacggttacggacgggtacgttcccggaggtccgtaacggtacgcgtaaagggtnacggnagcgtgacangnnntngtnnntcnnnncnnnnnnnncannnnnnnnnnnnnnnnnnnnnnnnnnn

SEQ ID NO: 61376 - DNA, 518 bp, Homo sapiens
  misc_feature: GYAE6OF02F222F.34.75.G09.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (468)..(469): a, c, t, g, unknown or other
  misc_feature (468)..(469): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(486): a, c, t, g, unknown or other
  misc_feature (483)..(486): n is a, c, g, or t
  modified_base (490)..(492): a, c, t, g, unknown or other
  misc_feature (490)..(492): n is a, c, g, or t
  modified_base (499)..(499): a, c, t, g, unknown or other
  misc_feature (499)..(499): n is a, c, g, or t
  modified_base (501)..(504): a, c, t, g, unknown or other
  misc_feature (501)..(504): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
tcagtacacgtgatcacgaccggtgctcgatttagtatagacatcagggactacttagcttggttccagcagaaaccaggacagcctcctaagttgctcatttcctgggcatctacccgggatccggggtccctgaccgattcagtggcagcgggtctgggacagatttcactctcacatcaccagcctgcagcctgaagntgtgctagtttatctgtcagcaagtattatgtccnccgctctacgttcggacggacggaccgtagggtgacgactacgaaacgtacgtggtgctcggacaccgtattcgtcggttacctacgtactttccgttaccgtccctaagttccgtaagaacctttcggaccgttcgtaacgtggtacgggcgggctacggacgtacgggcctagaacgtgctgtcgngngactgctcgagttnagcntccngtactggntacgncgcgngnncgagtcgagngntnnnnactnnncgcgtcncnnnngcngtntncngatg

SEQ ID NO: 61377 - DNA, 501 bp, Homo sapiens
  misc_feature: GYAE6OF02FZXCJ.34.75.G09.1.454.CMB.1.raw
  modified_base (190)..(190): a, c, t, g, unknown or other
  misc_feature (190)..(190): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (462)..(501): a, c, t, g, unknown or other
  misc_feature (462)..(501): n is a, c, g, or t
tcagtacacgtgatcacgaccggtgctcgatttagtatagacatcagggactacttagcttggttccagcagaaaccaggacagcctcctaagttgctcatttcctgggcatctacccgggaatccggggtccctgaccgattcagtggcagcgggtctgggacagtatttcactctcaccatcacctancctgcagcctggaagatgtggacttaagtttattactggtacagtactaattaattattacgttccctccgtaccttcgttaaccgttttccgggggacgggtaacggggaaccctaaggggtggaaagagttaaccaaaacggtacctggtcggctgaccactntctgttccttacattccggttccccgactatacgtanaacttccgtacgtacgtacgtggacggcggggtctacgggaacgnggtacggactaggtaagnagnagcnnnnnnnnnnnnnnnnnnnnnnnnnnnnnnnnnnnnnnnn

SEQ ID NO: 61378 - DNA, 612 bp, Homo sapiens
  misc_feature: GYAE6OF02F52C6.34.75.G09.1.454.CMB.1.raw
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
  modified_base (502)..(502): a, c, t, g, unknown or other
  misc_feature (502)..(502): n is a, c, g, or t
tcagtacacgtgatcacgaccggtgctcgatttagtatagacatcgagggactacttagcttggttccagcagaaccaggacagcctcctaagttgctcatttcctgggcatctacccgggaatccggggtccctgaccgattcagtggcaggcggtctgggacagtatttcgactctcacatcacagcctgcagtccgtagaagtatggtagcctagttttatactgtcagtactaatattacgtcgtcctccgctctacgttcggacggaggacctaggtgaagactaccaacgtactggtagcctacggctaaccgtattccgtagttcctaacttactccctttacccggacttagtccgtaatacctccggtaagttcggttaaccggnggaaccgtaccgggggntacggggaacaagggtccctataaacgtgacgcgttaancgtagcagtacgtcngctagactagagacttggagtcagtactagtacgtanactactcgacgacgtagactacgacgtcgtcgtacgtacgacgtagtagtacgtagtgtacgtcgtacgttacgtacgtagtacgtacgtacgtacgtaccgtacgtacg

SEQ ID NO: 61379 - DNA, 377 bp, Homo sapiens
  misc_feature: GYAE6OF01BR1YT.37.85.H08.1.454.CMB.1.raw
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (337)..(377): a, c, t, g, unknown or other
  misc_feature (337)..(377): n is a, c, g, or t
tcagtagtgtagatcacgaccggtgctcgatttagtatcactcagtcgcgggaagatgaagacagatggtgcatccaccagggccactggcatcccagacaggttcagtggtagtgggtctgggacagacttcactctcgaccatcagctagactggagccttgaagattttgcagtgtattactgtcagcagtatggtggctcacccgggtatgttttgggccaggggaccaagctggagatcagacgaactgtggctgcaccatctgtcttcatcttcccggccatctgaactctacgactacgtgagcgggctggcaaggcgcaatagananannnnnnnnnnnnnnnnnnnnnnnnnnnnnnnnnnnnnnnnn

SEQ ID NO: 61380 - DNA, 331 bp, Homo sapiens
  misc_feature: GYAE6OF01EF5Z8.37.85.H08.1.454.CMB.1.raw
  modified_base (323)..(331): a, c, t, g, unknown or other
  misc_feature (323)..(331): n is a, c, g, or t
tcagtagtgtagatcacgaccggtgctcgatttagtatcactcagtcgagggaaggatgaagacagatggtgcatccaccagggccactggcatcccagacaggttcagtggtagtgggtctgggacagacttcactctcaccatcagcagactggagcctgaagattttgcagtgtattactgtcagcagtatggtggctcacccggtatgtttttggccaggggaccaagctggagatcagacgaactgtggctgcaccatctgtcttcatcttcccgccatctgaatctacactactgagcggctggcaaggcgcatagnnnnnnnnn

SEQ ID NO: 61381 - DNA, 327 bp, Homo sapiens
  misc_feature: GYAE6OF01DSYYI.37.85.H08.1.454.CMB.1.raw
  modified_base (323)..(327): a, c, t, g, unknown or other
  misc_feature (323)..(327): n is a, c, g, or t
tcagtagtgtagatcacgaccggtgctcgatttagtatcactcagtcgcgggaagatgaagacagatggtgcatccaccagggccactggcatcccagacaggttcagtggtagtgggtctgggacagacttcactctcaccatcagcagactggagcctgaagattttgcagtgtattactgtcagcagtatggtggctcacccgggtatgtttttggccaggggaccaagctggagatcagacgaactgtggctgcaccatctgtcttcatcttcccgcatctgaatctacactactgagcgggctggcaaggcgcatagnnnnn

SEQ ID NO: 61382 - DNA, 339 bp, Homo sapiens
  misc_feature: GYAE6OF01CCKA8.37.85.H08.1.454.CMB.1.raw
  modified_base (329)..(339): a, c, t, g, unknown or other
  misc_feature (329)..(339): n is a, c, g, or t
tcagtagtgtagatcacgaccggtgctcgatttagtatcactcagtcgcgggaagatgaagacagatggtgcatccaccagggccactggcatcccagacaggttcagtggtagtgggtctgggacagacttcactctcaccatcagcagactggagcctgaagattttgcaacttattactgtctacaagattacaattaccctcgtacgttcggccaagggaccaaggtggaagtcaaacgaactgtggctgcaacctatctagtcttcatccttcccgcatctagaactcacactactgacgcggctggaccaaggcgacagtagnnnnnnnnnnn

SEQ ID NO: 61383 - DNA, 330 bp, Homo sapiens
  misc_feature: GYAE6OF02JZ453.37.85.H08.1.454.CMB.1.raw
  modified_base (324)..(330): a, c, t, g, unknown or other
  misc_feature (324)..(330): n is a, c, g, or t
tcagtagtgtagatcacgaccggtgctcgatttagtatcactcagtcgcaggaagatgaagacagatggtgcatccaccagggccactggcatcccagacaggttcagtggtagtgggtctgggacagacttcactctcaccatcagcagactggagcctgaagattttgcagtgtattactgtcagcagtatggtggctcacccgggtatgttttggccaggggaccaagctggagatcagacgaactgtggctgcaccatctgtcttcatcttccgccatcctgaatctacactactgagcgggactggcaaggcgcatagnnnnnnn

SEQ ID NO: 61384 - DNA, 378 bp, Homo sapiens
  misc_feature: GYAE6OF02HJLA5.37.85.H08.1.454.CMB.1.raw
  modified_base (353)..(378): a, c, t, g, unknown or other
  misc_feature (353)..(378): n is a, c, g, or t
tcagtagtgtagatcacgaccggtgctcgatttagtatcactcagtcgcgggaagatgaagacagatggtgcatccaccagggccactggcatcccagacaggttcagtggtagtgggtctgggacagacttcactctcaccatcagcagactggagcctgaagattttgcagtgtattactgtcagcagtagtggtgctcgacccgggtattgttttcggacgtaagggaccaagcgtggagatacagaacgtaactggtggactcgacaccatctgttcttctacttcccgtacccgcatcagtaactctacactacgtgaggcgggctggacgaacggcgacaatagcannnnnnnnnnnnnnnnnnnnnnnnnn

SEQ ID NO: 61385 - DNA, 438 bp, Homo sapiens
  misc_feature: GYAE6OF02JOZ42.37.85.H08.1.454.CMB.1.raw
  modified_base (368)..(368): a, c, t, g, unknown or other
  misc_feature (368)..(368): n is a, c, g, or t
  modified_base (408)..(408): a, c, t, g, unknown or other
  misc_feature (408)..(408): n is a, c, g, or t
  modified_base (420)..(438): a, c, t, g, unknown or other
  misc_feature (420)..(438): n is a, c, g, or t
tcagtagtgtagatcacgaccggtgctcgatttagtatcactcagtcgcgggaagatgaagacagatggtgcatccaccagggccactggcatcccagacaggttcagtggtagtgggtctgggacagacgttcactctcaccatcagcagactggagcctgaagatttgcagtgtattactgtcagcagtatgggtggtctcgacccgggttattggtttttcggccgtagggggaccctaaggtccgtgggagtagtacgaggaccggtaaacgtggtacggaccttggaccgaaccctagtccgttgttccttcgtacttcctttcccccggctacttctacggtaactccgttacacctttacnggtaacgcgggtccgttggacctaaggccgacgtatcgancagtcagcatcnnnnnnnnnnnnnnnnnnn

SEQ ID NO: 61386 - DNA, 511 bp, Homo sapiens
  misc_feature: GYAE6OF01C53VV.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgcttctctggctccaagtctggcaacacggcctccctgaccatctctgggctccaggctgacgacgaggctcactattattgcagctcatatacaagcagcatcacttgggtgttcggcggagggaccgacctgaccgtcttaggtcagcccaaggctgcccctggtcactctcgttcccgccctcctcatctacactactgagcgggctcggg

SEQ ID NO: 61387 - DNA, 531 bp, Homo sapiens
  misc_feature: GYAE6OF01DXDXY.37.14.B03.1.454.CMB.1.raw
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgctttctctggctccaagtctggcaacacggcctccctgaccatctctgggctccaggctgacgacgaggctcactattattgcagctcatatacaagcagcatcacttgggtgttcggcggacgggaccgaccgtgacccgtcttacggtccacgcccgaaggcctcgcccccgtcggtccacctctcgttccccgcccttcctcactctaccactacacgngcgggntcggg

SEQ ID NO: 61388 - DNA, 516 bp, Homo sapiens
  misc_feature: GYAE6OF01AGBU5.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggcctcaggggtctctaatcgcttctctggctccaagtctggcaacacggcctccctgaccatctctgggctccaggctgacgacgaggctcactattattgcagctcatatacaagcagcatcacttgggtgttcggcggagggaccgacctgaccgtcgttaggtcagcccaaggctcgcccctcggtcactcctcgttcccacccttcctcactctacactactgacgcgggctcgg

SEQ ID NO: 61389 - DNA, 514 bp, Homo sapiens
  misc_feature: GYAE6OF01CW9KV.37.14.B03.1.454.CMB.1.raw
  modified_base (508)..(508): a, c, t, g, unknown or other
  misc_feature (508)..(508): n is a, c, g, or t
tcagtagtgtagatcacgaccggtgctcgatttagtgtgagtagttccggggactttgcctgggctctgctgctcctcaccctcctcactcagggcacgggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtcccaaactcataatttatgaggtcactaaacggccctcaggagtttctaatcgcttctctggctccaagtctggcaacacggcctcctgaccatctctgggctcaacctgaggacgaggctcactattattgcagctcatatacaagcagcgtcacttgggtgttcggcggagggaccgactgaccgtcttaggtcagccaaggctcgcccctggtccactcgtcgttcccgccctcctcactctacactatcgngcggtc

SEQ ID NO: 61390 - DNA, 544 bp, Homo sapiens
  misc_feature: GYAE6OF01DYH68.37.14.B03.1.454.CMB.1.raw
  modified_base (225)..(225): a, c, t, g, unknown or other
  misc_feature (225)..(225): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtgttataactatgtctcttggtaccaacatcaccaggacaaacgtcccaaactcatctattttgagtcactaatcggcctcaggtaactttctctcgtcttctctcgcctcaagtctcggcaacacgcctctgacctatctcgtggctcgagacgtgacggacgaggctacacttattatgctacgctacatactaacaagcaacgactatactacgttgggttcggttcgggcgggacgggtacccgtaccgtaggtaccgtcgttacggtcacggtacccgaacggcctccggccccgtggtaccc

SEQ ID NO: 61391 - DNA, 515 bp, Homo sapiens
  misc_feature: GYAE6OF01EOWWM.37.14.B03.1.454.CMB.1.raw
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgtttggtggttataactatgtctcttggtaccaacatcacccaggcaaagtcccccaaaactcatgatttatgaggtcactaaaacggccctcaggggtctctaatcgcttctctggctccaagtctggcaacacggcctccctgaccatctctgggctccaggctgacgacgaggctcactattattgcagctcatatacaagcagcatcacttgggtgttcggcgggaggaccgacctgacccgtcgttaggtcacgcccaaggcctcgccccctcggtcc

SEQ ID NO: 61392 - DNA, 532 bp, Homo sapiens
  misc_feature: GYAE6OF01DDW7O.37.14.B03.1.454.CMB.1.raw
  modified_base (126)..(126): a, c, t, g, unknown or other
  misc_feature (126)..(126): n is a, c, g, or t
  modified_base (231)..(231): a, c, t, g, unknown or other
  misc_feature (231)..(231): n is a, c, g, or t
tcagtagtgtagatcacgaccggtgctcgatttagtgtgagtagttccgcgggggggtctcaggaggcagcgctctcaggacatctccaccatggcctgggctctgctgctccctccaccctcctnactcaggcacagggtccgtggcccgagtacgtgccctgaactcagcctgcctccgtgtctgggtctcctggacagtcgatcaccatctcctgcactggaacccgnagtgacgttggtggttataactatgtctctggtaccaacatcacccaggcaaagtccccaaactcatgatttatgaggtcactaaacggcctcagggtctctaatcgcttctctggctccaagtctggcaacacggcctcctgaccatctctgggctccaacctgaggacgacggctcactattattgcagctcatataacaagcagcgtcacgttgggtgttcgggccggtagggacccgaccgtgaccggttcttaggttcacggcccgaaggtctacgccccctcggtcacgttcccg

SEQ ID NO: 61393 - DNA, 521 bp, Homo sapiens
  misc_feature: GYAE6OF01CBYCS.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcaccaggcaaagtcccaaatcatgattttatgaggtcacttaaacggccctcaggggtctctaatcgcttctctggctccaagtctggcaacacggcctccctgaccatctctgggctccaggctgacgacgaggctcactattattgcagctcatatacaagcagcatcactttgggtgttcggcggacgggacgacctgaccgtcgttaggtcacgcccaaggcctacgcccctcggtcactctcgttccccgccctcctcactctacactactgacgcgggctcggg

SEQ ID NO: 61394 - DNA, 528 bp, Homo sapiens
  misc_feature: GYAE6OF01BOCBK.37.14.B03.1.454.CMB.1.raw
  modified_base (387)..(387): a, c, t, g, unknown or other
  misc_feature (387)..(387): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaaagtccccaaatcatgatttatgaggtcactaaaacggccctcaggggtctctaatcgcttctctggctccaagtctggcaacacggcctccctgaccatctctgggctccaggctgacgacgaggctcactattattgcagctnatatacaagcagcatcacttgggtgttcggcggagggaccgaccgtgaccgtcttacggtcacgcccaaggcctcgccccctcggtcaccgtctcgttccccgccctccctcactctacctactactgacgcggcgtacgg

SEQ ID NO: 61395 - DNA, 533 bp, Homo sapiens
  misc_feature: GYAE6OF01BMSW7.37.14.B03.1.454.CMB.1.raw
  modified_base (225)..(225): a, c, t, g, unknown or other
  misc_feature (225)..(225): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccncagtgacgttggtgttataactatgtctcttggtaccaacatcacccaggcaaagtccccaaactcatgatttatgagtcactaaaacggccctcaggggtctctaatcgcttctctggctccaagtctggcacacggcctccctgaccatctctggctccaggctgacgacgaggctcacttattattgcagctcatataacaagcagcatcacgttgggtcgttcgggcgggacgggaccgccgtagacccggttcgttacggtccacggtccccgaaggtcctccggccccccgttggtaccccg

SEQ ID NO: 61396 - DNA, 535 bp, Homo sapiens
  misc_feature: GYAE6OF01DA1UB.37.14.B03.1.454.CMB.1.raw
  modified_base (245)..(245): a, c, t, g, unknown or other
  misc_feature (245)..(245): n is a, c, g, or t
  modified_base (415)..(415): a, c, t, g, unknown or other
  misc_feature (415)..(415): n is a, c, g, or t
  modified_base (526)..(526): a, c, t, g, unknown or other
  misc_feature (526)..(526): n is a, c, g, or t
tcagtagtgtagatcacgaccggtgctcgatttagtgtgagtagttccgcgggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttanaactatgtctcttggtaccaacatcacccaggcaaagtccccaaactcatgatttatgagtcactaaacggccctcagggtctctaatcgcttctctggctccaagtctggcaacacggcctccctgacaatctctgggctccaggctgaggacgaggctgattattacngtctgctcatatgacgtaggtagtcacttcttatcgttcgttcggaacttcggggaacctaagggtcctacccggtcctaaagtcaacgtcccaaacggacccaaaccccncgtgtaccc

SEQ ID NO: 61397 - DNA, 516 bp, Homo sapiens
  misc_feature: GYAE6OF01B6AZC.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgcttctctggctccaagtctggcaacacggcctccctgaccatctctgggctccaacctgaggacgaggctcactattattgcagctcatatacaagcagcgtcacttggggtgttcgggcggagggaccgactgaccgtcttaggtcagcccaaggctcgcccctcggtcactctcgtcccaccctcctcactctacactactgagcggctggcacgg

SEQ ID NO: 61398 - DNA, 556 bp, Homo sapiens
  misc_feature: GYAE6OF01DFUI2.37.14.B03.1.454.CMB.1.raw
  modified_base (189)..(189): a, c, t, g, unknown or other
  misc_feature (189)..(189): n is a, c, g, or t
  modified_base (229)..(229): a, c, t, g, unknown or other
  misc_feature (229)..(229): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttggtaccaanatcacccaggcaaagtccccaaatcatgattatgaggtcactaaacggcctcagggtctctaatcgctttctctggctccaagtctggcaacaccggcctccctgaccatctcgtgggcctccgaggctgaccgacgacggctcacttattattgcagctcaatatacaagcagctatctacgttgggtcgttcgggcgggacgggtaccgaccgtggacccgttcgttacggtccacggacccgaaggccgtcgcccccgttcggtccaccttcctcgttccccacccttcctcactcctactactactggacgcgggtctacggg

SEQ ID NO: 61399 - DNA, 513 bp, Homo sapiens
  misc_feature: GYAE6OF01CMU9D.37.14.B03.1.454.CMB.1.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (421)..(421): a, c, t, g, unknown or other
  misc_feature (421)..(421): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtgttanaactatgtctcttggtaccaacatcacccaggcaaacgtccccaaactcatgatttatgaggtcactaaacggcctcagggtctctaatcgcttctctggctcaagtctgcaacacggcctcctgaccatctctgggctccaggctgacgacgagctcgactattatgcagctcataanacaagcagcatctacgttagggtgttcgggcggagggacccgtacgtgaccgttcgttacggtcacgcccgaagctccgcccctcggtaccc

SEQ ID NO: 61400 - DNA, 635 bp, Homo sapiens
  misc_feature: GYAE6OF01B0F2F.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttgtaccaacatcaccaggcaaacgtcccaaatcatgatttatgaggtcaactaaacggcctcgaggggtctctaatcgcttctctggctccaagtctggacaacgaccggcctcctagaccatctcgtcgggctccgagctgacgacgaggctacacttattatcgacacgtctacaataactaacaagaccaagacattactaacggtttgggttcggttccgggacgggtaacgggaccgaaccgtcggtacccgttcgttaacggtccgaccgacccgtaaggcccgttccggaccccccgttcgggtccctaccgttcccgtcccggtttccccgtccccttcccgtcctaccttaccttaacccttaaccgtttaccgtacggtaccgggtccggggtccgttaaccgggg

SEQ ID NO: 61401 - DNA, 518 bp, Homo sapiens
  misc_feature: GYAE6OF01A9Y9Y.37.14.B03.1.454.CMB.1.raw
  modified_base (491)..(491): a, c, t, g, unknown or other
  misc_feature (491)..(491): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcaggggtctctaatcgcttctctggctccaagtctggcaacacggcctccctgaccatctctgggctccgggctgacgacgaggctcactattattgcagctcatatacagcagcatcacttgggtgttcggcggagggaccgacctgaccgtcttacggtcagcccaaggcctcgcccctcggtcactctcgttcccgccctcctcnctctacactactcgagcggcgtggacg

SEQ ID NO: 61402 - DNA, 524 bp, Homo sapiens
  misc_feature: GYAE6OF01DS7DJ.37.14.B03.1.454.CMB.1.raw
  modified_base (225)..(225): a, c, t, g, unknown or other
  misc_feature (225)..(225): n is a, c, g, or t
  modified_base (363)..(363): a, c, t, g, unknown or other
  misc_feature (363)..(363): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccncagtgacgttggtggttataactatgtctcttggtaccaacatcacccaggcaaagtccccaaactcatgatttatgaggtcactaaacggccctcgaggggtctctaatcgcttctctggctccaagtctggcaacncggcctcctgaccatctctgggctccaggctgacgacgagctcactattatgcagctcatactacaagcagcaatcacgtttgggtcgttcgggacggagggacccgaccgtggaccgttcgtaggtccacgtcccaaggcctccgtcccccgtggtaccc

SEQ ID NO: 61403 - DNA, 596 bp, Homo sapiens
  misc_feature: GYAE6OF01BREIY.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaaacgtccccaaatcatgattttatgaggtcaactaaacggccctcaggggtctctaatcgctttctctggctccaagtctggcaacacggcctccctgaccatctcgtgggcctcgaggctcgacgacgaggctcacttattattgctagctacatataacaagcagcatctacgttgggtcgttcggcgggacgggaccgacctcggtaccgtcgttacggtcacgacccgaaggccctaccggcccccgttcggtacctaccgttcccgttccggttcccccgtccccttccctccgtaacttacccttaaacctacctaaccgttaggacggtcccggggtcttaccgggg

SEQ ID NO: 61404 - DNA, 524 bp, Homo sapiens
  misc_feature: GYAE6OF01DSXJP.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgctttctctggctccaagtctggcaacacggcctccctgaccatctctgggctccaggctgacgacgagctcactattattgcagctcatatacaagcagcatcacgttgggtgttcggcggaggaccgacgtgaccgtcttaggtcacgcccaaggcctcgcccccgtcgtcacttccgtcgttccccgccctcctcactcctactactactgacgcgggctacgg

SEQ ID NO: 61405 - DNA, 537 bp, Homo sapiens
  misc_feature: GYAE6OF01EXUJ3.37.14.B03.1.454.CMB.1.raw
  modified_base (369)..(369): a, c, t, g, unknown or other
  misc_feature (369)..(369): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccccgcagtgacgttggtggttataaatatgtctcttggtaccaacatcaccaacatcaccccaggcaaagtccccaaactcataattatgagtcactaaacggccctcagagtttctaatcgcttctctgctccaagtctggcaacncggcctccctgaccatctctggctccaactgaggacgaggctcactattatgcagctcaatatacaagcagcgtcacgttgggtcgttcgggcgggtacgggacccgtaccgtaggcccgtcgttacgggctacggaccccaagggccctccggccccccgttccggg

SEQ ID NO: 61406 - DNA, 563 bp, Homo sapiens
  misc_feature: GYAE6OF01AJ650.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggcctcaggggtctctaatcgcttctctggctccaagtctggcaacacggcctccctgaccatctctgggctcaggctgacgacgaggctcactatattgcagctcatatacaagcagcatcactttgggtgttcgggcgggagggacccgaccgtgacccgttcttacgggtcctacggccccaagggtccgtacgcccccgttcgggtccaccgttcctccgtttcccccacccttccttccgacttcccgtaactaccttactaggacgccggggtctacgggg

SEQ ID NO: 61407 - DNA, 552 bp, Homo sapiens
  misc_feature: GYAE6OF01EEIYP.37.14.B03.1.454.CMB.1.raw
  modified_base (404)..(404): a, c, t, g, unknown or other
  misc_feature (404)..(404): n is a, c, g, or t
  modified_base (491)..(491): a, c, t, g, unknown or other
  misc_feature (491)..(491): n is a, c, g, or t
tcagtagtgtagatcacgaccggtgctcgatttagtgtgagtagttccggggactttgcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaaacttataaccttgtctcttggtaccaacagcacccaggcaaaacgcccccaaatcatgattttgtgaggacagtaagcggcccttcagggggttttctaatcgcttctctggcctccaagtctggcaacgacggcctcctgacaatcctcgtgggctccgaggctggaggacgaggtctgtatttattactgctgctcatangctaggtatcacttcttatgttcgttacggaacgtcgggaaccgaaggtccaccgtacctaagtcacgacccaacggacccaacccnctcgtaccacttcctacgttccccaccctcctacacttcctaccacttactgcggtccggg

SEQ ID NO: 61408 - DNA, 571 bp, Homo sapiens
  misc_feature: GYAE6OF01DII0C.37.14.B03.1.454.CMB.1.raw
  modified_base (225)..(225): a, c, t, g, unknown or other
  misc_feature (225)..(225): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtgttaataactatgtctcttggtaccaacatcaccaggcaaacgtccccaaaactcatgtatttatgaggtacactaaaacggccctcaggggtctctaatcgcttctctggctccaagtctggcaacacggcctccctgaccatcctcgtcgggctccgaggctcgaacgacgaggctacgacttattattgcagctcatataacagcagcatcgtacgttgggtcgttcgggacgggtaacgggtacccggaccgtggtaaccccggttcgtttagggttcccaacggttccccgaacgggtacctcccggtccccccgttcggggttacccc

SEQ ID NO: 61409 - DNA, 639 bp, Homo sapiens
  misc_feature: GYAE6OF01DK6JY.37.14.B03.1.454.CMB.1.raw
  modified_base (189)..(189): a, c, t, g, unknown or other
  misc_feature (189)..(189): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttggtaccaacatcacccaggcaaagtccccaaatcatgatttatgaggtcactaaacggcctcaggggtctctaatcgcttctctggctccaagtctggcaacacggcctccctgaccatctcgtggcctcagctgacgacgagctcactattatgcagctcatatacaagcagcatcagttgggtgtcggcggacgggaccgtaccgtcggtacccgttacgttacggtcctaacggaccccgaacgggtccgtacccggtcccccccgttacgggttcccctaacccgtttcccgtttccccgggtttcccccccggtccccccttttaccccttcccgttaaccgttacccctttaaacccgtaaccccgtttaccgtacgggtaacccgggtcccgggggtccgttaacccggggg

SEQ ID NO: 61410 - DNA, 533 bp, Homo sapiens
  misc_feature: GYAE6OF01EDTK0.37.14.B03.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
  modified_base (162)..(162): a, c, t, g, unknown or other
  misc_feature (162)..(162): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcatcaggcacnggtcngggccaggtcaggcctgactcgngctgcctcgtgtctgggtctcctggacagtcatcaccatctcctgcactggaacccgcagtgacgtttggtggttaataactatgtctcttggtaccaacatcacccaggcaaagtccccaaatcatgatttangagtcactaacggcctagagggtctactaatcgcttctctgctcagtctgcaacncgcctcctgaccngtctcgtggctccgaggctgacgacgagctcacttattagtgcanctcatataacagcagcagtctacgttgggtacgttcggacgggaacgggacccgtacgtacggtacccgttcgttacgggtacacgggacccgtaacggaccgtcccgtcccccgtgggtaccc

SEQ ID NO: 61411 - DNA, 549 bp, Homo sapiens
  misc_feature: GYAE6OF01EOFIR.37.14.B03.1.454.CMB.1.raw
  modified_base (227)..(227): a, c, t, g, unknown or other
  misc_feature (227)..(227): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtgttataactatgtctcttggtaccaacatcacccaggcaaagtcccccaaactcatgatttatgaggtcactaaacggccctcgagggtctctaatcgcttctctggctccaagtctggcaacacggcctccctgaccatctcgtggcctccaggctgacgacgaggctcacttattattgcagctacatactacaagcagcaatctacgttgggtcgttcgggcgggaacgggacccgaccgtaggacccggttcgttacgggtccaacgtccccgaacggtcctcccggtccccccgttcggtacccc

SEQ ID NO: 61412 - DNA, 552 bp, Homo sapiens
  misc_feature: GYAE6OF01DDPFP.37.14.B03.1.454.CMB.1.raw
  modified_base (229)..(229): a, c, t, g, unknown or other
  misc_feature (229)..(229): n is a, c, g, or t
  modified_base (542)..(542): a, c, t, g, unknown or other
  misc_feature (542)..(542): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaanatcacccaggcaaagtccccaaaatcatgatttatgaggtcaactaaacggccctcgagggtctctaatcgtcttctctgctccaagtctggcaacacggcctcctgaccatctcgtggctccgaggtcagacgacgaggctcactattattgcagctacataatacaagcagcagtactagtttgggtcgttacgggcgggacggtaccgaccgtggtaacccgtcgttaggtccgacgcccaagccgtacgcccccgtgtccacgtccttcgtcccctacctcctctacgtcctaccactaccgagacggnggtcgtacgg

SEQ ID NO: 61413 - DNA, 607 bp, Homo sapiens
  misc_feature: GYAE6OF01A3KGL.37.14.B03.1.454.CMB.1.raw
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcaggggtctctaatcgcttctctggctccaagtctggcaacncggcctccctgaccatctcgtgggctccnggctgacgacgagctcactattattgcagctanatatacaagcagcatcacgttgggtggttcgggcgggacgggacccgtaccgtacggtaccggttacgttaacggtccgaaccgtaccccgaaacgggtccgtcggtccccccgttcggtcctacgtttccttccggtttccccctaccccttacccgttcctaacgttacccttaacccgtaaccttacccgttaggacggtccggggtccgtacgggg

SEQ ID NO: 61414 - DNA, 525 bp, Homo sapiens
  misc_feature: GYAE6OF01AHVTM.37.14.B03.1.454.CMB.1.raw
  modified_base (496)..(496): a, c, t, g, unknown or other
  misc_feature (496)..(496): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggcctcaggggtctctaatcgcttctctggctccaagtctggcaacacggcctccctgaccatctctgggctccagctgacgacgaggctcactattattgcagctacatatacaagcagcatcacgtttgggtgttcggcgggacgggaccgaccgtgaccgtcgttaggtcacgcccaggtcctcgccccctggtccactctcgttccccgcccttcncactcactactactgacgcgggctacggg

SEQ ID NO: 61415 - DNA, 519 bp, Homo sapiens
  misc_feature: GYAE6OF01EP1NR.37.14.B03.1.454.CMB.1.raw
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaaactcatgatttatgaggtcactaaaacggccctcaggggtctctaatcgcttctctggctccaagtctggcaacacggcctccctgaccatctctgggctccaggctgacgacgaggctcactattattgcagctcatatacaagcagcatcacttgggtgttcggcggagggacccgacctgaccgtcttaggtcagcccaaggctcgcccctcggtccactctcgttccccnccctcctcactctacnctactgacgcggntcgg

SEQ ID NO: 61416 - DNA, 618 bp, Homo sapiens
  misc_feature: GYAE6OF01DRU5N.37.14.B03.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
  modified_base (609)..(609): a, c, t, g, unknown or other
  misc_feature (609)..(609): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactcggaaccnagtgacgttggtagttanaactatgtctcttgtaccaacatcaccaggacaacgtaccccaaactcatgatttangtaggtcaacgtaaaccggccctacgaggtacgttactaactcgtactttctcgtcggtctacccaagttcctcggacaaccgaccggtccctcccgtacgaccctacttccgtcgttcgggtcctaacccgtaaccgtaggaacgggaccggacggtacctacgtaactttatttaacttcgacctagtcctataactataacaacgctacgtcgtacgtacggtttgggtcggttaccggcgggacgggcccgtacgtcgtaccgtgttacggcgacgcccgaagtcctaccgtccccgtcggtcnccgttcccg

SEQ ID NO: 61417 - DNA, 706 bp, Homo sapiens
  misc_feature: GYAE6OF01BW774.37.14.B03.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctctcactcagggcacgagggtcctgggcccagtctgccctgactcagcctgcctccgtgtctgggtctccgtggacagtcgatcaccatctcctgcacgtcggaacccgnagtgacggttggtagttanaactatgtctcttagacaacactacaccagacaaacgtacccaactcatgtatttagtagacgtacaacgtaaccgcctacgacgggtctactactcgtcttcgtcgtcggtcctaccgaagtcgtacggacctaaccgacccggtccctacccgtacgaccctacttccgtcgtccgggtcctaccggacggtcgtacggaaccggtaacggacggtaccttaccgtaacgtttacgttacgttcgaccgtaacgttccctaactaacgttaacgtaaccgaaacgtccgtaaacgtacctaaacgtttccgtaacgggtttggggttacgggttaccggggacggggtaaccgggtacccgtaccggtaccggttacccggttacggttaaccgggtaccgaaccggttacccggtaacggtccccgttcccggtcccccggttcggttacccg

SEQ ID NO: 61418 - DNA, 644 bp, Homo sapiens
  misc_feature: GYAE6OF01B4B0P.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcacatctcctgcactggaacccgcagtgacgttggtggttataactatgtctcttggtaccaacatccacccaggaccaaacgcccccaaatcatgtatttgtgaggacagtaacgcggccctgaggggtttctaatcgcttcgtctggctccaagtctggacaacgcggcctcctcgacctatctcgtgggctcgagctggacgacgaggctacgactattatcgcgagtcgtacaattactaacaagtcaagcgtactcgtacgtttcgggtcggttcggacgggacgggacccgtaccgtcggtaaccgttacgttacggtaccgacgtacccgtaagggtccctacggtccccccgtacggtacccgtaccttacccggttacccgttcccccgtaccccttcccttacccgttaaccgtacccttaaccgtacccttaaccggtcggtaaccggggtccgggtccgtaaccgggg

SEQ ID NO: 61419 - DNA, 584 bp, Homo sapiens
  misc_feature: GYAE6OF01BLQXF.37.14.B03.1.454.CMB.1.raw
  modified_base (228)..(228): a, c, t, g, unknown or other
  misc_feature (228)..(228): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcaggcacagggtcctgggcccagtctgccctgactcagcctgcctccgtgtctgggtctccgtggacagtcgatcaccatctcctgcacgtggaacccgnagtgacgttggtgttataactatgtctcttggaccaacatcaccgaggcaaacgtcccccaaaactcatgtatttatgaggttcactaaacggccctcgagggtctctaatcgtcttctcgtcgctaccaagtctggcaacgaccggccctccctgacctatctcgtcggcctccgaggctaggacgacgagggcctcgacttacttagttcgacgtacgctacgaatactacaagctacgctaacttctacgttgggttcgttcgggaccggtacgggtaccgtaccgttcggaccggttcgttacggtcgaaccggtacccgaacggtcctaccggtcccccgttcggtacccg

SEQ ID NO: 61420 - DNA, 538 bp, Homo sapiens
  misc_feature: GYAE6OF01B2MUC.37.14.B03.1.454.CMB.1.raw
  modified_base (227)..(227): a, c, t, g, unknown or other
  misc_feature (227)..(227): n is a, c, g, or t
  modified_base (405)..(405): a, c, t, g, unknown or other
  misc_feature (405)..(405): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttggtaccaacatcacccaggcaaagtccccaaactcatgatttatgaggtcactaaacggccctcgaggggtctctaatcgcttctctggctcaagtctggcaacacggcctccctgaccatctcgtgggctccgaggctgacgacgnggctcactattattgcagctcatactacaagcagctatcacgtttgggtgttcgggcgggacgggtacccgaccgtaggtacccgtcgttacggcacggtacccgaagggtcctcggcccccgttcggtaccc

SEQ ID NO: 61421 - DNA, 648 bp, Homo sapiens
  misc_feature: GYAE6OF01A5BZX.37.14.B03.1.454.CMB.1.raw
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactcggaacccgcagtgacgttggtgttataactatgtctcttggtaccaacatcaccaggacaaacgtaccccaaactcatgtatttatgaggtcaactaaacggcccgtacgaggggtctactaagtcgtcttcgtctggctaccaagtcgtggacaaccgacgtccctcctgacctatccgtcgtcgggcctccgaggtcgtacgacgacggacggcctactacttattagtgctagctacataactacaacgactagacctagtaccgtacggttggggttcggttaccggggtacggggtaacccggggtacccggtacccggttacgggttaacccgggttcccgtttaacgggtacccgtaacccgggtaacccccggtaacgggaccccgttccccgggttccccccgttccgggttacccccg

SEQ ID NO: 61422 - DNA, 543 bp, Homo sapiens
  misc_feature: GYAE6OF01AZ19G.37.14.B03.1.454.CMB.1.raw
  modified_base (301)..(301): a, c, t, g, unknown or other
  misc_feature (301)..(301): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccagcaacgtccccaaactcatgatttangagtcactaaacggcctcgagggtctctaatcgcttctctggctccaagtctggcaacacggcctccctgaccatctcgtgggcctccgaggctcgacgacgacggctcacgttattattgcacgctacataactacaagcagcatctacgttgggtcgttcgggcggacgggtaccgaccgttagacccggttcgttacgggtcacggtacccacggccgtccgcccccgttcggtacccg

SEQ ID NO: 61423 - DNA, 616 bp, Homo sapiens
  misc_feature: GYAE6OF01DYGTP.37.14.B03.1.454.CMB.1.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactcggaacccgcagtgtacgttggtgttataactatgtctcttggtaccaacatcacccaggacaaagtccccaaactcatgattttangtaggtcaactaaaccggccctagacgggtctactaatcgctttctcgtgctcgaagtcgtgacaacnccggcctcccgtcgacctatctcgtcgggtcctaccgacggtcgtacggaccgaacggacggtcctacgtaacttatttacgttgctagtctacgaataactacaaagctagaccgttctaacggttgggttcgggttccggacggggaccgggaacccgtaccgttacggtaacccgtttcggttagggtcccaaccggtacccgaacggtccgtaccccgcccccgttcggtcccgttacccg

SEQ ID NO: 61424 - DNA, 324 bp, Homo sapiens
  misc_feature: GYAE6OF01B6P57.37.14.B03.1.454.CMB.1.raw
  modified_base (319)..(324): a, c, t, g, unknown or other
  misc_feature (319)..(324): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgccctggaaccagcagtgacgttggcagccaaggctcgccccctcggtcactctcgttcccgccctcctcatctacactactgagcggctggcaaggcgcatagnnnnnn

SEQ ID NO: 61425 - DNA, 557 bp, Homo sapiens
  misc_feature: GYAE6OF01AOQUB.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataaatatgtctcttggtaccaacatcaccaacatcacccaggcaaacgtccccaaactcataatttatgagtcactaaacggccctcaggagtttctaatcgcttctctggctccaagtctggcaacacggcctccctgaccatctctggctaccaacctgaacggacgaggctcacttattattgcagctcatatacaagcagctctacgttgggtgtttcgggcggagggaccgacgtcgaccggttcttaggtcacgcccaacggctacgccccctcggtccaccgtcctccggttccccgccccttccctccgtactccgtaccacttacgtcgtacggcgggtccg

SEQ ID NO: 61426 - DNA, 772 bp, Homo sapiens
  misc_feature: GYAE6OF01CK154.37.14.B03.1.454.CMB.1.raw
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctctcactcagggcacagggtcctgggcccagtctgccctgactcagcctgcctccgtgtctgggtctccgtggacngtcgatcaccatctccngcactggaaccnagtgacgttggtgttaanaactatgtctcttggtaccaacatcaccaggacaaacgtaccccaaactcatagtatttatagacggtcaacctaacggccctcgacgggtctacgtaactccgtcttcctcgtggtcctaccgaacgttccgtacgggacctaaaccgtacccgggtaccctaccccgtacgaacccgtaacttccgttaccggttacggggtccttacccggaacgggtacccgttacgggaaaccggtaaccgggaacgggtacccttaccgtaaaccgtttaacgttaacgtttacggacccgtaacggtcccgttaaccgtaaatttaacctaaacgtaaacggacccttaacgggacccttaacgttacccggtacggttttacgggggtttccgggttaccggggaacccggggtaaccgggggtaaccccgtacccgttacgggtaacccggtttaccggttaaacgggtaccttaacccggacccggtaaacggtcccgtttaacccgggcccccgttacgggtaccccg

SEQ ID NO: 61427 - DNA, 708 bp, Homo sapiens
  misc_feature: GYAE6OF01AJMXY.37.14.B03.1.454.CMB.1.raw
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaaccatcctcctgcacgtcggaaaccccgcaggtcggtacggtttggttaggtttaattaactatgtctcgttcggtaccaacatccacccgaggaccaaacgtaccccaaactcatagtattatgtaggtaccaacgtaaaccggccctacgagggtctactaagtccgtcttctcgtcgtcctaccgaagtcgtcggccaaccgtaccggtcccttccctacgtaccctacgtccgtcgtcgggtcctccgtacgggtcgttacggaaccggtacggtacggtacctacctaactttagttacttgtaccgtacgtctacaattaactaaccgagactacgtactacgtccgtacggtttcggggttcggttaccggggtaccgggaaccggggtaacccgtacccggttacggttaaccccggttaccggtttacgggtacccgtaaccggtaccccgtaacgggtacccgtccccggtcccccggttccggtaacccccgg

SEQ ID NO: 61428 - DNA, 556 bp, Homo sapiens
  misc_feature: GYAE6OF01CN7IG.37.14.B03.1.454.CMB.1.raw
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcaccaggcaaacgtccccaaactcatgtatttatgaggtcaactaaacggccctgagggtctctaatcgtcttctctggctccaagtcgtggcaacgaccggcctcccngaccatctcgtcggctcccgaactgaggacgnggctcactattatgcagctcatatacaagcagcgtactacgttgggtgttcgggcggacgggaccgacgtcgaccgttgttacggacacgacccgtacgcctcgccccgtcggtcctacgtcctccgttcccgaccctcctacgacttctacccactacctcggacgccgggctgggcgacggg

SEQ ID NO: 61429 - DNA, 599 bp, Homo sapiens
  misc_feature: GYAE6OF01EEJC6.37.14.B03.1.454.CMB.1.raw
  modified_base (189)..(189): a, c, t, g, unknown or other
  misc_feature (189)..(189): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttggtaccaacatccacccaggcaaaacgtccccaaaactcatgatttatgaggtcactaaacggcctcgagggtttctaatcgtcttctctggctcaagtctggcaacacgcctcctgacatctctcggctcgaggctggaggacgaggctgatttatactgctgctcatagtgcgtaggtacgtctacttctttagtgttcgttacgggaacgttcggggaacctaacgggtccctaaccgttaccgtaagtccgaacggaccccaaacggaccccaaacccctacgtccgtaccaccgttccgtccgttcccccgccccttccctactcttaccctaacctaaccgttacgtacggaacggccgggtccgtgggaccg

SEQ ID NO: 61430 - DNA, 550 bp, Homo sapiens
  misc_feature: GYAE6OF01DAJ43.37.14.B03.1.454.CMB.1.raw
  modified_base (229)..(229): a, c, t, g, unknown or other
  misc_feature (229)..(229): n is a, c, g, or t
  modified_base (421)..(421): a, c, t, g, unknown or other
  misc_feature (421)..(421): n is a, c, g, or t
tcagtagtgtagatcacgaccggtgctcgatttagtgtgagtagttccggggactttgcctgggctctgctgctcctcaccctctcactcagggcacagggtcctgggcccagtctgccctgactcagcctgcctccgtgtctgggtctcctggacagtcgatcaccatctcctgcactggaacccgcagtgacgtttggtggttataactatgtctcttggtaccaanatcaccaggcaaacgtccccaaatcatgattttatgaggtcaactaacggccctcgagggtctcgtaatcgcttctctggctccaagtctggcacacgcctcctagaccatctcgtggctccgaggctagacgacgaggctcaactattatgcagctacatatacaagcagcatcacgtttgggtcgtcggnggacggacgacctgtaccgttcgttacgcagacccaaggtctaccgcccctacggtccaccgttccgccgtttcccccgcttcccctcgtacttccctaaccgtacttaccgtggcgcgggcgtaccgg

SEQ ID NO: 61431 - DNA, 529 bp, Homo sapiens
  misc_feature: GYAE6OF01A5FCY.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaaactcatgatttatgaggtcacttaaacggccctcaggggtctctaatcgcttctctggctcaagtctggcaacacggcctccctgaccatctctgggctccgaggctgacgacgaggcctgactattattgcagtctcatatacaagcagcatcacgttgggtgttcgggcggagggaccgaccgtcgaccgtacttaggtacagccctaaggcctcggccccctggcctacctctcgttcccgccctcctcactcactactactgacgcggctcgg

SEQ ID NO: 61432 - DNA, 701 bp, Homo sapiens
  misc_feature: GYAE6OF01BIWEQ.37.14.B03.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (323)..(323): a, c, t, g, unknown or other
  misc_feature (323)..(323): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctgccctgactcagcctgcctcgtgtctgggtctccgtggacagtcgatcaccatcctctgcactcggaaccnagtgacgttggtagttanactatgtctcttaggtaaccaactactacaaccaacactccaacccaggacaaacgtaccccaaatacaattaattanagtagtacaacgtaaacgccctagaggtagttactaatcgtacttctacgtcggtacctacgaagtccgtagtaccaacgtaccggtccctacccgtacgaacctacttacccgtcgtcgggtacctccgaacgggccgttacggaaccggtaacgggacggttaccctaacgtaaccgtttaagttaacgtttcggtacctaacggtccgttaacctaaattaaccgtaaaccgaaacggctaaggacctaaacgtacggttaaccggtttgggttacgggttaccggggaacgggtaacggggtacccgtaccggtacggtacccggttaacgttacggtaccgaacggtcccgaaacggtcccgttacccccggg

SEQ ID NO: 61433 - DNA, 597 bp, Homo sapiens
  misc_feature: GYAE6OF01DF1ST.37.14.B03.1.454.CMB.1.raw
  modified_base (285)..(285): a, c, t, g, unknown or other
  misc_feature (285)..(285): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggacaaacgtccccaaactcatgatttatgagtcaactaaacggcctnaggtatttctaatcgctttctctggctccaagtctggcaacncgcctccngaccatctctggctccaactgagacgnggctcactattattgcngtctacatatacaagcagcgtactcgtttgggtcgttcgggacggacgggacccgtacgtcgtaccgttacgttacggtccaacggcccgtaaggtccctccggtccccccttggtaccctaccgttccgttcccgtttcccccaaccccgttccctactacttccctaaccctaacttaccgtacggacggtccgggtacgtcgggcgaaaccgggg

SEQ ID NO: 61434 - DNA, 552 bp, Homo sapiens
  misc_feature: GYAE6OF01ARYE3.37.14.B03.1.454.CMB.1.raw
  modified_base (301)..(301): a, c, t, g, unknown or other
  misc_feature (301)..(301): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtgttataactatgtctcttggtaccaacatcacccaggcaaacgtccccaaactcatgatttangaggtcacgtaacgcctcgagggtctctaatcgcttctcgtgctccaagtctggccaacgaccggccctccctgacctatctcgtggcctcaggctgacgacgaggctcgacttattattcgctagctactaatatacaacgctagctatcacgttgggtcgttcgggacgggtacgggaccgtaccgtcggacccgttcgttaggcccgaacgtaccccgacggtacccgtcccgccccgtaccgggtcc

SEQ ID NO: 61435 - DNA, 708 bp, Homo sapiens
  misc_feature: GYAE6OF01C3TA2.37.14.B03.1.454.CMB.1.raw
  modified_base (229)..(229): a, c, t, g, unknown or other
  misc_feature (229)..(229): n is a, c, g, or t
tcagtagtgtagatcacgaccggtgctcgatttagtgtgagtagttccggggactttgcctgggctctgctgctcctcaccctcctcactcagggcacagggtcctgggcccagtctgtcctgactcagcctgcctccgtgtctgggtctcctggacagtcgatcaccatctcctgcactggaacccgcagtgacgttggtggttataactatgtctcttggtaccaanactccacccaggaccaaacgtaccccaaactcatgtatttatgaggtcaacgtaaaccggccctacgacgggtctctaatcgtctttctctcggctccaagtcgtggacaaccgaccggtccctccctcgaccatcctcgtcggcctaccgacggtctacggaccgacggacggtctacgtaacttatttacttacggctaacgtcctactaacttaacgtaacgaacgaccagtacctaacgttaccgtaacggtttcggggttaccggttacggggaccggggtaacgggaacccggtacccggttacggtaaccccggtttacggttaaccggtaccgtaaccggaccccgtaacgggtccccgttcccggtcccccggttacggttacccgtaccgttcccgttcccggttcccccgtccccttcctacctaccttacctacctaccgtacgtcggacggccgggtcgtaccggg

SEQ ID NO: 61436 - DNA, 681 bp, Homo sapiens
  misc_feature: GYAE6OF01CUEVB.37.14.B03.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (325)..(325): a, c, t, g, unknown or other
  misc_feature (325)..(325): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctcctcactcagggcacgagggtcctgggcccagtctcgccctgactcagcctgcctccgtgtctgggtctcgtggacagtcgatcacatctcctgcactcggaacccnagtgtacgttggtgttaanaactatcgtacttcgttacggtaaccaactataccacccgaaggaccaaacgtaccccaaactcaattgtaatttanacgtaacggtacaacgtaaaccgtccctacggaagggttcctataacgtctcctttctcgtacggtcctaaccgtaagttctacgggaacaaccgaccggtcccttaccggtacaaacctattccgttccggtacggtccgttaccgaggtccgtacggaaccggaacggtaaccggtaccttacgtaacttactttaagtcgactacgtctaacagttaacaaccgagacacgtacacttagttaccggttggtacggttaccgggacggtaaccggaccgtacgtacggtaccggttacgttacggtccaaccgtacccggaacggtcccgttacccgtccccgtcgtaacccg

SEQ ID NO: 61437 - DNA, 689 bp, Homo sapiens
  misc_feature: GYAE6OF01DTYQ8.37.14.B03.1.454.CMB.1.raw
  modified_base (229)..(229): a, c, t, g, unknown or other
  misc_feature (229)..(229): n is a, c, g, or t
  modified_base (265)..(265): a, c, t, g, unknown or other
  misc_feature (265)..(265): n is a, c, g, or t
  modified_base (665)..(665): a, c, t, g, unknown or other
  misc_feature (665)..(665): n is a, c, g, or t
tcagtagtgtagatcacgaccggtgctcgatttagtgtgagtagttccgggggactttgcctgggctctgctgctcctcaccctcctcactcagggcacagggtcctgggcccagtctgtcctgactcagcctgcctccgtgtctgggtctcctggacagtcgatcaccatctctgcactggaacccgcagtgacgttggtggttataactatgtctcttggtaccaanatccaccaggacaaacgtaccccaatcatgatttangagtcaactaacggcctgagggtctactaatcgtctttctcgtcggcctaccgaagtcgtggaccaacgaccggcctccctgacccatccgtcgtacgggtcctaccgacggtccgtacggaaccggtacggacggtccttaccgtaactttacgtttaattcggacctagtccttactaacttaacgtaaacgaacggtacaacgtacgtaacttccgttaacggtttcggggtcgttaccgggacgggtacggaccgtaccgtacgtaccgttacgttacggaccgacgtaccccggaaggtcccttaccggtcccccgttcggtacccttccggtacccgttccccggttccccctccccgttccctacttaccgttaccctaccgtaccttacggnggaccggtccgggtccggtacggg

SEQ ID NO: 61438 - DNA, 667 bp, Homo sapiens
  misc_feature: GYAE6OF01DBXKE.37.14.B03.1.454.CMB.1.raw
  modified_base (140)..(140): a, c, t, g, unknown or other
  misc_feature (140)..(140): n is a, c, g, or t
  modified_base (327)..(327): a, c, t, g, unknown or other
  misc_feature (327)..(327): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgngtctgggtctcctggacagtcgatcaccatctcctgcactggaaccgcagtgacgttggtggttataactatgtctcttggtaccaacactcacccaggacaaacgtccccaaactcatgtattatgaggtcactaaacggcctcgagggtctactatcgctttctctcgctcaagtctggcaaccncggcctccctcgaccactctcgtcgggctccgaggtctagaccggacgacggtcctacctacttaatttagtttacgctacgtccttacgtaattaactaacaacgacaacgtactacgttacgtacgggtttcgggttcggttccgggaccgggaacgggtacccgtaccgtcggtacccggttacgttaccgggtacctaccggacccgtaacggtcccgtacccggtcccccgttcggttaccctacccgttccgttacccggttcccccgtcccttcccttacctaccttacctaacctaccgttaacgtcggaacgggtccgggtcggtaccggg

SEQ ID NO: 61439 - DNA, 642 bp, Homo sapiens
  misc_feature: GYAE6OF01C1ZKT.37.14.B03.1.454.CMB.1.raw
  modified_base (363)..(363): a, c, t, g, unknown or other
  misc_feature (363)..(363): n is a, c, g, or t
  modified_base (620)..(620): a, c, t, g, unknown or other
  misc_feature (620)..(620): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtcttcttggtaccaacactcacccaggacaaacgtccccaaactcatgtattatgagtcactaaacggcctgagggtctctaatcgtcttctcgtcggctccaagtcgtggcaacaccggcctccctcgaccatcctcgtcggcctcgnggctgacgacgacgctactacgtattatcgcagtcctactaattactaacaagtcacgtacctatccgtacggtttcggggttacggttccgggacgggtaacgggacccgtaccgttcggtaacccgttcgttacggtaccgtaccggacccgtaacggtcccgtacccggtcccccgttaccggtacccgtacccgttccgttcccggttcccccgtccccttcccgtactaccgttacctacctaccgttacgnggtaccggcgggtcgtaacggg

SEQ ID NO: 61440 - DNA, 710 bp, Homo sapiens
  misc_feature: GYAE6OF01DAN5L.37.14.B03.1.454.CMB.1.raw
  modified_base (250)..(250): a, c, t, g, unknown or other
  misc_feature (250)..(250): n is a, c, g, or t
tcagtagtgtagatcacgaccggtgctcgatttagtgtgagtagttccgcggggggggtcacaagaggcagcgctctcgggacgtctccaccatggcctgggctctgctgctcctcactctcctcactcgagggcacgagggtcctgggcccagtctgccctgactcagcctgcctcgtgtctgggtctccgtggacagtcgatcaccatctcctgcacgtggaaccagcagtgtacgttggtagttaanaatatgtactcttaggtaccaacatcaaccaacatccaccgaggacaaacgtacccaaactcaataagttatagaggtacactaaacggccctagacggtatttactaatccgtactttctctggtctaccgaagttctcgggaacaaccgaccggtccctccccgttcgaaccctacgttccttaccgtcgggtaccctaccccgtaaaccgttcggaacgggtaaccgacgggtccttaccgtaactttaacgtttacgttcgacgtacgtccttaactaacgttaaacgtaaccgtaacgaccgtacgtaccggtttacccgttaacgggtttcgggggtttacggttcccggggacgggtaaccggggaccccgtaaccggttcgggtacccgttacggtttacggtaccgtaaccggtaccccgtaagggtccctcccggtaccccccgttccgg

SEQ ID NO: 61441 - DNA, 632 bp, Homo sapiens
  misc_feature: GYAE6OF01BS580.37.14.B03.1.454.CMB.1.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
tcagtagtgtagatcacgaccggtgctcgatttagtgtgagtagttccggcgggggggggtctcaggaggcagcgctctcaggacatctccaccatggcctgggctctgctgctcctcaccctctcactcagggcacagggtcctgggcccagtctgccctgactcagcctgcctcgtgtctgggtctcctggacagtcgatcaccatctctgcactcggaacccncagtgacggttggtagttaatactatgtctcttgtacaantcaccagacaaacgtaccccaaactcatcgatttatgagtcaacgtaaccggcctacggagggtctactatcgcttctctggcctacaagtctggaccaacacggtcctcctcgacctatctcgtcgggtcctccgaggtcctaggaaccgtacgacggtcctacaacgtttattacgttgaccgtactaccttaacattaacctaacgaaggacctaaggacctagtacccgttacgggtttcggggtacgggttccggggacggaaccgggggtacccggtacccggtaggtacccggttcgtacggtaaccgacccggtacccgtaacggtcccgttacccggtcccccgttcgggttacccc

SEQ ID NO: 61442 - DNA, 613 bp, Homo sapiens
  misc_feature: GYAE6OF01ELJLM.37.14.B03.1.454.CMB.1.raw
  modified_base (227)..(227): a, c, t, g, unknown or other
  misc_feature (227)..(227): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcatgggcccagtctgccctgactcagcctgcctccgtgtctgggtctcctggacagtcgatcaccatctcctgcactcggaacccnagtgacgttggtgttatactatgtctcttgtaccaacatcaccaggcaaacgtaccccaaactcatgtactttatgagtacaactaacggccctgacgggtctactaatcgtcttctctgcctcaagtcgtggaccaaccgacgtccctccctgacctactccgtcgtcggcctccgacgggtctacggaccgacggacggcctactaactttattacgttcgcacgtctacataactacaacgtacacgtcaacttacgtacggtttggggtacggttccggggaacgggtacggggtaccccgtaccggttacggtacccgttacgttacgggtaccgtaccggaccccgtaacgggtcccgttccccggcccccgttacccgg

SEQ ID NO: 61443 - DNA, 703 bp, Homo sapiens
  misc_feature: GYAE6OF01BCUNC.37.14.B03.1.454.CMB.1.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacaggggtcctgggcccagtctcgccctgactcagcctgcctccgtgtctgggtctccgtggacagtcgactcaccatctcctgcacgtcggaacccnaggtgtacggttggtagttataactatgtctctgaccaanactacacagacaaccgaccccaactcactcttagttttcgacggtcaactaacgtccgacctacgacggttaactttccttctcgtccttctcgtcgtaccctacgtaagtccgtacggaacctaaccgtacccgggtccttaccgtacggacctacgttccgtccgtacgggtccctacgtacgtacgtacggaacgggtaacggtacggtacgttagtaactttaacgttaccgtagtaccttagtttaacctagttaagtacggaacgggtaccaaacctacttaacgtttacgttcggtacggttaacgggtaacgggtaccgggtaaccgtaacggggtccgttacgttaaccgttaacggtcccaaccggaccccggtaaaccgtaccccgaacccgttacgtaccttaccgcccgtttacccgg

SEQ ID NO: 61444 - DNA, 540 bp, Homo sapiens
  misc_feature: GYAE6OF01EW19I.37.14.B03.1.454.CMB.1.raw
  modified_base (523)..(523): a, c, t, g, unknown or other
  misc_feature (523)..(523): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggcctcaggggtctctaatcgcttctctggctcaagtctggcaacacggcctccctgaccatctctggctccgaggctgacgcgaggtcctcactattattgcagctcatatacagcagcatctacgttgggtgttcgggcgggacgggacccgacgtcggacccgttgtacggtcacggcccaagggcctacgcccctcggtcctactccttccggttcccgccctcctcactcctacgtactacncggtacgcgggctcggg

SEQ ID NO: 61445 - DNA, 592 bp, Homo sapiens
  misc_feature: GYAE6OF01EH536.37.14.B03.1.454.CMB.1.raw
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcaccaggcaaagcccccaaatcatgatttgtgaggacagtaagcggccctnaggggtttcaatcgcttctctggctcaagtctggcaacncggcctccctgacactctctgggcctccgaggctggaggacgaggcttgatttatactgtctgctacatatcggactaggtacgttcaccttctttacttggttacctttaccgggaaaccgttacgggggtaaccctaaaggggttcccctaacccggtttccccgtaaaaggtttcccaaacgggaccccccaaacggggaccccctaaaacccccccgtaacgttcccgg

SEQ ID NO: 61446 - DNA, 706 bp, Homo sapiens
  misc_feature: GYAE6OF01DA2IE.37.14.B03.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcacgtggaacccnagtgacggttggtgttataactatgtctcttggtaccaanatccaccaggacaacgtaccccaaactcatgtattangacgtacaacgtaaaccggccctacgacgggtctactaactcgtcttctcgtggtcctacgaacgtcgtcggactaaccgaccggtccctacccgtacgaacctatccgtcggtcgggtcctaccgacggtctacggaccgacggacggtcctacgtaacgtttattacgttacgaccgtaacgtccttaaccgtaacttaacgtaaacccgaagtaccgtaacggacctaacgttaccgttacgggtttcggggtttacgggttaccggggaaccggggtaaccgggtaacccccgggtaaccgttaccgggttaaccccggttaccggttacgggttaacccgaccggtaaccccgtaacgggtccccgtacccggtccccccggttacgggttacccc

SEQ ID NO: 61447 - DNA, 740 bp, Homo sapiens
  misc_feature: GYAE6OF01CLL6L.37.14.B03.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcgtggacagtcgatcacatctctgcactcggaaccgnagtgacggttggtgttaataatntgtctgtgtacanatcaccaanctccaccgagacaaacgtacccaactcaattaattangagtacaactaaaccggcctagtacgggtttctaactcgtacttcgtcgtagtcctaccgaagtcgtacggaccaaccgtaccggccctaccctagaacctaacttccgtacgtcgggtccgttacccgaagggtccttagggaacggtacggtaacggtcgttacgttaactttaacgtttaccgtcggtacttcggtaacctttacgtaagtttacgtaccggtacggttaaacgggtttacgtaccgttaacctttaccgtttaggtttacccggtttccggttaaaccgggtaaaccggttaacgggggtaaaccccttaaacggggtttcccccgtaaaccccggttaacccggttaaacgttacccgtaaacccgggaaccccccgtaaacccggggttaaacccccctaaacccccggttaacccgg

SEQ ID NO: 61448 - DNA, 596 bp, Homo sapiens
  misc_feature: GYAE6OF01CYWRG.37.14.B03.1.454.CMB.1.raw
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagtagtgtagatcacgaccggtgctcgatttagtgtgagtagttccggggactttacctgggctctgctgctcctcaccctcctcactcagggcacagggttctgggcccagtctgccctgactcagcctgcctccgtgtctgggtctcctggacagtcgatcaccatctcctgcactggaacccgcagtgacgttggtggttataactatgtctcttggtaccaacatcacccaggcaaacgtccccaaatcatgtatttatgaggtcaactaacggccctcgaggggtctctatcgcttctctggctcaagtctggacacaccggcctccctnaccatctcgnggcctccgaggctgacgacgagctcactattntgcanctacatataacagcagcatcgtacgttggtcggtacgggcggacgggaccgaccgtacggtaccgttcgttacggtaccgacggtcccgaacggcctacccggtccccgtaccggtcctaccttccgttccgttcccccacccgtttccctaccgtaccttaccttaacctaccgttaccgttacggacgggtcccgggcggtcggaaccgg

SEQ ID NO: 61449 - DNA, 717 bp, Homo sapiens
  misc_feature: GYAE6OF01DZ4TA.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcacatctcctgcactggaacccgcagtgacgttggtggttataactatgtctcttggtaccaacatccacccaggcaaacgtccccaaatcatgatttatgaggtcactaaacgcctcaagggtctctaatcgcgttctctggctccaagtctggcaacacggcctcctgaccatccgtctcgggctccgaggtctggaaccgtacggacggtcctacgtaacttattatttacggactaacggtcctactaagttaacgtaaacgtaacgacctaacgggtactaaccgtttaccgaacgttttcgggggttaacggttttccggggaccgggtaacgggggtaacccgtaccgttacggtaacccggtttcttaacgggtccgtaacggtccccgttaaacggccgttacccggtaccccccttcgggtacctaccgttccgttacccgggtttacccccctacccgttaccccgtttaccgaaccgtttaccccgttaaccgtaaccgttaccgttaccgggacggttccggggacccgttaaccggggg

SEQ ID NO: 61450 - DNA, 569 bp, Homo sapiens
  misc_feature: GYAE6OF01B4B96.37.14.B03.1.454.CMB.1.raw
  modified_base (212)..(212): a, c, t, g, unknown or other
  misc_feature (212)..(212): n is a, c, g, or t
  modified_base (435)..(435): a, c, t, g, unknown or other
  misc_feature (435)..(435): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatntgtctcttggtaccaacatcacaacatccaccagcaaacgtccccaaactcatgatttatgagtacactaaacggcctcgagggtctctaatcgcttctctggctcaagtctgcaacgacggcctcctgaccatctcgtcggcctccgaggctacggacgacgaggctacacttattatgcagctacatataacaagtcagcatctagttgggtggttcgggnggacgggaccgacgtcgaccgttcttacggtcgacgtacccgaagtcccgtccgcccccgttcggtccacccgtttccgtcccgttacccccaccccgttccctacctaacttccctaaaccgtcttacccggg

SEQ ID NO: 61451 - DNA, 656 bp, Homo sapiens
  misc_feature: GYAE6OF01DUT4S.37.14.B03.1.454.CMB.1.raw
  modified_base (269)..(269): a, c, t, g, unknown or other
  misc_feature (269)..(269): n is a, c, g, or t
  modified_base (343)..(343): a, c, t, g, unknown or other
  misc_feature (343)..(343): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactcggaacccgcagtgacgttggtaggttataactatgtctcttggaccaacatccaccaggacaaacgtccccaaaactcatgtatttangagtacaacgtaaacgcctgacgggtctactaatcgctttctcgtcgctcaagtctgacaacaccggtcctccngaccatctcgtggcctaccgaacgtcgaggacgacggtctacgtacttattagttcgacacgtctacaattacaacgaagacagtcgtactacgtttggggtcgttacgggacggtacgggtacccgtacgttacggtacccgttacgttacggtaccgaccgtacccgtaacggtcccgtcccgtaccccgttcgggtaccctaccgttccgttcccgtttacccccgtccccttcccgttactaccttacccttaccctaacgttcccgttacggacgggttacccgggacgtacgggcccgtaaacgggg

SEQ ID NO: 61452 - DNA, 646 bp, Homo sapiens
  misc_feature: GYAE6OF01DZ8C0.37.14.B03.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
tcagtagtgtagatcacgaccggtgctcgatttagtgtgagtagttccggcggggggggtctcagggaggcagcgctctcaggacatctccaccatggcctgggctctgctgctcctcaccctcctcactcagggcacagggtccctgggcccagtctgccctgactcagcctgcctcgtgtctgggtctcctggacagtcgatcaaccntctccngcactcggacccgcagtgtacgttggtagttaataactatgtcttcttacggtaccaacatccaccgaggacaacgtcccaaatcataattanagagtacactaaacggcctacgagtagttctaaatcgtacttctcgtcgtactacctaagttcncggtacaaccgtaccggcccttaccctgtaaccctatccgttcgtcggccttacccgagccgtagacccggtacgaacgtctacctaactttaacttcgttnacgtagtctctaattactaanacgactaagctaatcctacggttgggtcggttaccggggagggtaccgggtacccgtaaccgtccggtaaccgtttacggtttaacggaccgtaccggtacccggtaaacggccgttaacccggtcccccgtacgggttccctaacccgg

SEQ ID NO: 61453 - DNA, 576 bp, Homo sapiens
  misc_feature: GYAE6OF01DECZ9.37.14.B03.1.454.CMB.1.raw
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtgttataactatgtctctggtaccaacatcacccaggacaaacgtccccaaatcatgatttangaggtcaacgtaacgcctgagggtctactaatcgcttctctggctcgaagtctcggcaacgcgcctccctgaccatctcgtgggctccgaggatacgacgacgagctacgattattatgcagctcaatactaacaagcgagctacttacgtacggtttggggtacgttccgggaccgggtacgggacccggtaccgtacggtacccggttacggttacggtaccaacggtaccccgtaacggtcccttacccggtccccccgttcggtaccccg

SEQ ID NO: 61454 - DNA, 648 bp, Homo sapiens
  misc_feature: GYAE6OF01EDOBL.37.14.B03.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtgttanaaagtatgtctcttggtaccaanatcaccaacatcacccaggacaaagtccccaaactcaattaatttatgaggtacaactaaaacggccctacaggtacgtttctaaactcgtcttctcgtcggtctaccctaagttctagggaccaaaccgtaccggtcccttaccccgttacggaaccctaactttcccttccgttcggggtacccttacccgtaaaccctggaaacgggtaccgacgggtcctactacttatttagttcgcctagtcctactaattaacgttaacaaacgcacgtcgttacgtaacgttggggttacgttccggggacgggtaccggggacccgtacgtcggtacccgtcgttaggcctacgacccgaaggtcctcccgtccccgtaccgg

SEQ ID NO: 61455 - DNA, 643 bp, Homo sapiens
  misc_feature: GYAE6OF01CCRRJ.37.14.B03.1.454.CMB.1.raw
  modified_base (225)..(225): a, c, t, g, unknown or other
  misc_feature (225)..(225): n is a, c, g, or t
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
tcagtagtgtagatcacgaccggtgctcgatttagtgtgagtagttccggcggggggggtctcaggaggcagcgctctcaggacatctccaccatggcctggctctgctgctcctcactctcctcactcagggcacgagggtcctgggcccagtctcgccctgactcagcctgcctcgtgtcgtggtctcgtggacagtcatcaccatcctctgcactggaaccngcagtgacgttggtagttataaatatgtctcttacgtaaccaacatacaaccaactactaccaaccgaaggaaccaaaccgtaccccaaaactctatacgtattttagtacggtaagtaccaaaccgtaaaaccggtcccgtacgacgggttacctacgttaactccgtctttcctacgtcgtctacgtaacgtcgtacgactaaccgacccggtcccttaccgtacgacctacttccgtcgttccgggaccttaccggacggtcgtacgacgggaacgcggtacctacgtaactttagttacgttcgactacgtacctnttaaactanaacagacacgtactacgtctacggttcgggtaggtcgggacggacgggtaccgtaccgtcggaaccgttagtacgtcgaacggtacccg

SEQ ID NO: 61456 - DNA, 758 bp, Homo sapiens
  misc_feature: GYAE6OF01D8PBM.37.14.B03.1.454.CMB.1.raw
tcagtagtgtagatcacgaccggtgctcgatttagtgtgagtagttccggcggggggggtctcaggaggcagcgctctcaggacatctccaccatcggcctgggctctgctgcctcctccaccctcctcactcgaggcacgacgggtccgtcgggcccagtctcgccctgactcacgcctcgcctccgtgtcgtcgggtcctccggtgacagtcactaccactacttcctcctagaccacgtaccggaacccgcgtacggtaggttacggttagggttaggttaacttaacttagttcgttccgttacggtttaacggtaaaccctaactaactacccaacccggaacggtaaccaaaacccgtaaccccctaaacgtcctaaagttagttaacgtttacgtacgggtaccggtaacctaaacccggtaaccggtcccgtacgggttacgggttaccttacgtaacgttcctacgttctaccgtcgtcctaccgtagttccgacggaacctaccgacccggtcccttacccgtactactaccgtcgtcggacctacgacgtctacggacgacgtacgtctactacttattctcgacagtacctataatacgtaacacgacgataccgttacttacggttcggttacggttcgggaccggtacgggaccggtacccgtaccggttaccggtaccggttacgttccggaaccgtaccgccggtaaccggcccgtaccccgtccgtccggtccttacccgg

SEQ ID NO: 61457 - DNA, 684 bp, Homo sapiens
  misc_feature: GYAE6OF01DJETV.37.14.B03.1.454.CMB.1.raw
  modified_base (80)..(80): a, c, t, g, unknown or other
  misc_feature (80)..(80): n is a, c, g, or t
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
tcagtagtgtagatcacgaccggtgctcgatttagtgtgagtagttccggcgggggggtctcagggaggcagccgctccncaggaccatctccaccagtggcctgggctctgctgctcctcaccctcctcactcgagggcacagggtcctgggccctagtctcgccctgactcagcctgcctccgtgtcgtcgggtctcctgggacagtcgagtcacctatctcctgccacgtcgaaacccgntagtgtacggttgtagttaataactntcgtctcgtacgtaacaactactaccaccgacgactaaaccgtaaccctaaactctatagtaattacgtaggtaacggtacgtaaccgtaaccggtccgtacggtacggtactacgtaactcgttcttcgtacgtacgtactaccgtagtcgtacggaccaacgtaccgtaccctacctactacctactcctcgtcggtactacgacgacgtacgaccggaacgacgtactactaattaatacgtatacgacgtactactaataactaacgacgacgaacgtacgtacttacgttacggttgggtacgggttacgggaccggggtaacggtacccggtacggtacggtaccggttacgttacggtaccgtaaccggtacccggaacggtacccgtcccggtaccccgtcggtacc

SEQ ID NO: 61458 - DNA, 752 bp, Homo sapiens
  misc_feature: GYAE6OF01EF2BI.37.14.B03.1.454.CMB.1.raw
  modified_base (241)..(241): a, c, t, g, unknown or other
  misc_feature (241)..(241): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctcgccctgactcacgcctgcctccgtgtcgtgggtctccgtaggacaggtcgatccacctagtcctcctgcctacgtcggaacccntaggtgtacggtttggtagttaataactatcgtctcgttaggtaccaacactccaccgaggaccaaacgtacccctaaaactcaattacgtatttagacgtaacggtactaacgtaaaccggtccctacggtaggggttacctacttaaacgtccgtacctttcgtcgtcggtaccttaccgtaacgtcgtacggacctaaacgtaccggtccccttaccgacgtacccgtatacctcgtcgggtaccctcgtacggctggaaccgacggacgtaccgtactaacttacgttacgttacggcctacggtactacctaacttaacgtaacaacggtccaaggtcctaacgttacggtaaccgggtttgggttaccgggttaccgggggaccgggtaacggggtaccccgttaaaccggggttcgaccccgggtttacggttaacggttacccggaacggtaacccggtacgggttaccccgttaccccgggtccccgttacccgggtacccc

SEQ ID NO: 61459 - DNA, 605 bp, Homo sapiens
  misc_feature: GYAE6OF01CDW4T.37.14.B03.1.454.CMB.1.raw
  modified_base (492)..(492): a, c, t, g, unknown or other
  misc_feature (492)..(492): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggacagtcgatccaccatcctcctgctacgtcggaacccgcagtgtacgttggtagttaataactatgtctcttcggaaccaacactcacccaggacaaaccgtaccccaaactcaatgtatttagtagtagtacaacctaacggtccctacgagggtactactaactcgtcttctcgtgactacagtcgtgacacgcgccctcctacgactactcctcgtcgggcctccgtacggctagaccggacgacggccttcaacgttattactgtacgtacgtctactaataactaactaacgntacgactactcggtacgttgggtcgggttcggacggaccggggtactccggtacgtacccggttcgtacggtacaccggtaccgtacgccgtcccgtccccggtggttacccg

SEQ ID NO: 61460 - DNA, 815 bp, Homo sapiens
  misc_feature: GYAE6OF01DJH9Z.37.14.B03.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagtagtgtagatcacgaccggtgctcgatttagtgtgagtagttccggcgggggggtctcaggaggcagcgctctcaggacatcctccaccatggcctgggctctgctgctcctcaccctcctcactcgagggcacgagggtcctgggcccagtctcgccctgactcagcctgccctcgtgtcgtgggtctccgtggacngtcgactcacctatcctcctggacctacgtaccggaacccgnaggttgtaacggtttggtagtttaaactacgttagttcgttcctttacgttacggtaacccaaactacgttcccaacccgtaacggaccaaacccggttaacccccaaaactaccgtaattcgtaacttttagacggtacggtacctaaaccgtaaaccggtcccccgttaagggacgggtttacctacttaaccgtcgtccgtttcctcgttacggccgttaccgtaaggtccgtacggtaaccaaccgggacccgtacccctaccgtacgaaaccttcgttcgttaccgtcgggtccttaccggacggtaccgtacggtaaccgggtacggacggttactaccgtaacgtttacgttacgtttgaccgttacgtactaactaactaacgtaaacgacgtacgaccggttactacgttacgttaccgggttcgggttaccgggttacggggaaccgggtaccgggaaacccggttccgttaccggggttaacccgttccggttaacggcccgtaacccggtaccgtaaccgggttcccgtaccccgggtcccccgttgggttaacccccg

SEQ ID NO: 61461 - DNA, 666 bp, Homo sapiens
  misc_feature: GYAE6OF01DGNZ9.37.14.B03.1.454.CMB.1.raw
  modified_base (189)..(189): a, c, t, g, unknown or other
  misc_feature (189)..(189): n is a, c, g, or t
  modified_base (380)..(380): a, c, t, g, unknown or other
  misc_feature (380)..(380): n is a, c, g, or t
  modified_base (644)..(644): a, c, t, g, unknown or other
  misc_feature (644)..(644): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtaggttataactatgtctcttagtaccaacactccacccaggacaaacgtaccccaaactcatgtatttatgagtcaacgtaacggcctgagggtctctaactcgtcttctctcggctccaacgtcgtacggacaacgaccggtccctcctacgacctactctcgtcgggtcctaccggnggcgtacggaaccggtacggacggctacgtaacttatttattcgtacgaacgtcctactaattaacgtaacaacgactaacgactaacttaccgtacgggtttcggggttacgtccggggtcggggaaccgggtacccgtacgttcggtaccgttacgttacggtacgaccgacccgtaggtcccgtaccgtcccccgtcggtacctaccgttccttcccgtacccctaccccctcttaccctactccctaacgtaccttacgnggtaccgggtcggtcgtacggg

SEQ ID NO: 61462 - DNA, 710 bp, Homo sapiens
  misc_feature: GYAE6OF01C7TJR.37.14.B03.1.454.CMB.1.raw
  modified_base (204)..(204): a, c, t, g, unknown or other
  misc_feature (204)..(204): n is a, c, g, or t
tcagtagtgtagatcacgaccggtgctcgatttagtgtgagtagttccggggactttgcctgggctctgctgctcctcaccctcctcactcagggcacagggtcctgggcccagtctcgccctgactcacgcctgcctccgtgtcgttgggtcctccgtggacaggtcgatccacctatcctcctgccacgtacgggaacccgngaggtggtacggttggttagttaataactgtgttcttcgttacgtaaccaactactaccaaccgaggtaccaaaccgtacccctaaatctaattgtaatttagaggtacgtaccaaccgtaaccggcctacgaggttacttactaacgtcgtctttcgtcgtcgtacctacgtagtcgtacggacctaaccgccgtcctaccgacgacctacgtccgtcgtcggaccctaccgaacggtaggaacggacggtagtacctaccttaagttagttactacgacgtacgtactactataactaacgacgtacgtacgtacgtacgttacggttgggttcgggtacgggacgggtacggtaccgtaccgtacggtaccgttcggtacgtaccgaccgtaccgtacgtccgtcccgcccgtccgtaccgtccgtcctcccgtccctaccctcgtacccccctactccctacgtaccgtacgacggtacggcggacggtcggacggtacggg

SEQ ID NO: 61463 - DNA, 873 bp, Homo sapiens
  misc_feature: GYAE6OF01CVIMT.37.14.B03.1.454.CMB.1.raw
  modified_base (226)..(226): a, c, t, g, unknown or other
  misc_feature (226)..(226): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactcggaacccnagtgacgttggtgttataaatatgtctcttggtaccaacatcaccaacatcaccccaggaccaaacgtaccccaaactcaattaatttagtaggaggtaccaacgtaaaaccgggtccccttacgaagggtacttttacctaacgttccggtaccttttccgtccgtacgggtacccttacccgtaaaggttcccgttacggggaaccctaaaccccggtacccggggttcccccttacccccgttacgggaaaccccttaacgttccccgtttaccggttaccgggggtacccctttaacccccgtaaacccggtttgggaaaccggggtaacccgggtaacgggtaccctttaacccgtaaaccgttttaacttttaaccggtttcgggaacccttaacgggtcccttaacctaaagttaaaccgttaaaccgaaacggaccgttaaacggtcccggttaccgttaaaccgggtttttcggggggttaccggtttacccgggggaccggggttaaccggggtaaacccccggttacccgttaaccgggttaaccccggtttacggtttaaccgggtccccgtaaacccgggtacccccggaaacggggttccccgtaccccgggtccccccccgtttacccgggg

SEQ ID NO: 61464 - DNA, 661 bp, Homo sapiens
  misc_feature: GYAE6OF01DWY3O.37.14.B03.1.454.CMB.1.raw
  modified_base (226)..(226): a, c, t, g, unknown or other
  misc_feature (226)..(226): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactcggaacccnagtgacgttggtgttataactatgtctcgttggtaccaacatcaccgacggacaaacgtccccaaactcatgtatttatgaggtacaactaaacggccctacgacgggtctactaatcgtcttctctcgctcctaagtctaggcctaacacggtccctcccgtacgacctactcctcgtcgggcctaccgaggcgtgaaccggacgaggtcctacgtaacttacgtttaagttcggtacacgtcctactaattaactaactaacggacgtaacgactacgttaccgtacggttttcggggttacggtttccggggaccggggtaacggggtacccggtaaccggttaccgggtaacccgtttcggttaaccgggtacccgaaccggtaccccggtaaacgggccccttcccggccccccggttcgggttaccccg

SEQ ID NO: 61465 - DNA, 623 bp, Homo sapiens
  misc_feature: GYAE6OF01AQJUL.37.14.B03.1.454.CMB.1.raw
  modified_base (229)..(229): a, c, t, g, unknown or other
  misc_feature (229)..(229): n is a, c, g, or t
  modified_base (489)..(489): a, c, t, g, unknown or other
  misc_feature (489)..(489): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctcctcactcagggcacgagggtcctgggcccagtctgccctgactcagcctgcctccgtgtctggtctcctggacagtcgatcacctatctctgcacgtcggaacccnagtgtacgttggtagttatactatgtcttgttcggacacactcaccgaacgacgactaacccgaccctaagtctagtatattagtacggtacgtacctaacgtaacccgtcgtacggtacggtactacgtacgtcgttcttctcgtcgtacctacgtagttcgacgacctaacgtcccgtccctacgtacactactccgtacggtccgtcctacggcggtcctacggaccgacggtcgtcctacttaacgttattcgccncgacgtcctataactaacacgacatacactctacggtcgggttggtccgggtacggaccggtaccggtacctacggtacggtacccgttcgtacgaccgtaccgtacccggagcccgttacccggcccgttacg

SEQ ID NO: 61466 - DNA, 812 bp, Homo sapiens
  misc_feature: GYAE6OF01DZJ6W.37.14.B03.1.454.CMB.1.raw
tcagtagtgtagatcacgaccggtgctcgatttagtgtgagtagttccggggactttgcctgggctctgctgctcctcaccctcctcactcagggcacagggccctgggcccagtctgccctgactcagcctgcctccgtgtcgtgggtctcctggacagtcgatcaccatctcctgcacgtacggaacccgctagtggtacggtttggtaggttaactaacttagtcgttcttcgttacggtaaccaactactaccaacccgaacggaacctaaaaccgtacccctaaactactaagttagttaattttaagacggtaacggtaacctaaaccggtaaaacccggtcccgttaccgggtaacggggttccttaacgttaacgttccgttacctttcgtcgttcggtacctaccgtaacgttcgtacggaacctaaacccgtacccgggtcccttacccgtacgtaccctacgttccgtaccggttaccgggtaccctaacccgtaaaccggtagggaaccgggaaccgtaggtaccgtagttaactttaacgttaccgtgtacgttacgttaccaagtttaacgacgggtaaccgtaccgtaaaccctacgttaacttacgttacggttaccgggttacgggtaacggtacgggtaaccgttacgggtccgttacgtaacctacggtacgaccgtaacccgaccgtaacccctaccgtacgttcgaccttccgtcgttaccctccccgtacccttcgtacctactacctacgtacgtagaccgggtaggccggtacacggacgtacgtacg

SEQ ID NO: 61467 - DNA, 871 bp, Homo sapiens
  misc_feature: GYAE6OF01D8WP8.37.14.B03.1.454.CMB.1.raw
tcagtagtgtagatcacgaccggtgctcgatttagtgtgagtagttccgcggggggggtctcaggaggcagcgctctcaggacatctccaccatggcctgggctctgctgctcctcaccctctcactcaggcacagggtcctggcccagtctgccctgactcagcctgcctcgtgtctgggtctccgtggacagtcgatccacctatctcctgcacgtcggaacccgcgaggtcgtacgtttggtagttaatactatcgttcttcgtttacggtaaccaacgtacttaccacccgtagggacctaaaaccgtaccccctaaaactccaattagtaagttttacgtaggtacggttacctaaccgtaaaccggtccccttacggtaacggggttaccttacgttaacgttccgtactttccgttcgttacgggtcccttaccgtaacgtttccgttacggaccgtaaaccgacccgggtccccttacccgtacgaacctaaccgttccgtaccgttcggggtaccctacccggtacgggtccggttaacgggacgggtaaccggtacgggtaccgttaagggtttaacttttaacgtttaaccgtcggttaccgttaccgttaccgttaaccgtaacgttacgtacggtaaccggttaacggggtttaacctaccgttaacgtttaaccgttttacgttaccgggtttaacccggttacccggggttaaaccgggttaacccgggtaaacccggttaaaccgggttaccccctaaacccggttacccgttaaaccggttaacccgaaccccggtaaccccggaaccccggtaaccccccgtaaacccccgttccgttacccgttaacccccg

SEQ ID NO: 61468 - DNA, 733 bp, Homo sapiens
  misc_feature: GYAE6OF01DW02V.37.14.B03.1.454.CMB.1.raw
  modified_base (235)..(235): a, c, t, g, unknown or other
  misc_feature (235)..(235): n is a, c, g, or t
  modified_base (688)..(688): a, c, t, g, unknown or other
  misc_feature (688)..(688): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtcgtgggtctcctggacagtcgatcaccatctcctgcactcggaaccgcagtgacgttggtagttaataactatgtctcgttacggtaaccaanactaccacccgaggaccaaaacgtaccccaaactcatagtatttagtggaacggtacaaccgttaaaccggccctacggaacggggttccttacgtaacttccgtctttaccgtcgttcggtccttaccgaacggttccgtacggaacctaaccgtacccgggtaccccttaccccgtacgtaacccgtacttccggttccggtcgggtcccttaccggacggtaccgtacggacggtaacggacgtccttactaactttagtttactcgactacgtctactataactaacaaagcaagtcaacttcgtacggtttcgggtacggttaccgggacgggaccggtaccgtaccgttacggaccgtttacggtacggtaccgaccggtacccgacggtccccgtacccgccccgttcgtaccgtcctaccgttacccgtacccctacctcctacnccgtttaccaaccgttactaccgtagggccgtcggtacgtccggg

SEQ ID NO: 61469 - DNA, 690 bp, Homo sapiens
  misc_feature: GYAE6OF01DZML6.37.14.B03.1.454.CMB.1.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (324)..(324): a, c, t, g, unknown or other
  misc_feature (324)..(324): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctctcactcagggcacagggtcctgggcccagtctcgccctgactcacgcctgcctccgtgtcgtgggtctccgtggacagtcgatcacctatctcctgcacgtcggaacccnagtgacggtttggtaggttaanaattatgtcttcgttacgtaccaactatccaaccgaggacaaacgtaccccaaatctatgtactttagngtagtacacgtaaccgcctacgtacgggtcttacgtactcgtcttccgtcgtcggtactaccgaagtctacggtaccaaccgtaccgtcccgtcccttacgaaccgtacttcctacggtcgggtcctaccggaggtctaacggaccggtaacggacgtcccttactaaccgtttagtttaacgttgaccgtaacgtacttacgtaacttaaacgtactaacgaccgaacgtacttacgtacgttacggtttcggggtacggttaccgggacgggtaaccgggacccgtaccgttcggttaccgttacggttaccggacgtaccggtaccctaacgggtcctccccgggttccccgtcggttaaccc

SEQ ID NO: 61470 - DNA, 698 bp, Homo sapiens
  misc_feature: GYAE6OF01DLMLT.37.14.B03.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (531)..(531): a, c, t, g, unknown or other
  misc_feature (531)..(531): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctcctcactcgagggcacagggtcctgggcccagtctcgccctgactcacgcctcgccctcgtgtcgtcggttctccgtgacagtcgatccaccatcctcctgaccacgtccggaacccngtaggtcgtacgttggtagttaataacttntcgttcttacgttacgaaccaactactaccaccgacgaacctaaaccgtaccccaaatcagttatatttagacgtacggtacctaaccgtaaccggtccgtacggacggttcctacgtacttccgtctttccgtcggtcgtacctaaccgtaggtcctacggaaccctaaccgtcccgaccctccgactaacctcgttcgtcggtacgccctacgtagctaaccggaacgtacggaccgttacctacgttactttaaagtntacgactacgtcctaagtaactaacgtaacgagacctacgcttacgttaacggtcgggtttagggaccgttcggggaccggtaaccggaccgttaaccgtcggttaacggtcgttaccgaccgttaccgaacccggtacgcccgtccccgtcccggtactaccccgg

SEQ ID NO: 61471 - DNA, 570 bp, Homo sapiens
  misc_feature: GYAE6OF01BTDSM.37.14.B03.1.454.CMB.1.raw
  modified_base (228)..(228): a, c, t, g, unknown or other
  misc_feature (228)..(228): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
tcagtagtgtagatcacgaccggtgctcgatttagtgtgagtagttccggggactttgcctgggctctgctgctcctcaccctctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaanatcacccaggcaaagtccccaaaatcatgatttatgagtcactaaacggcctcagggtctctaatcgcttctctggctacaagtctggcaacacggcctccncgaccactcnctgggctcgagctgacgacgaggctcactattattgcanctacatactaacaagcagcaatcacgttgggtgttcgggcggacgggtaccgacgtgacccgtcttacgggtcacgtcccgaaggacctccgcccccgttggtaccctaccgtcttcccggtttcccccgacccttcccgtcctaacgtcccttaaccaccgttactaggacggtccgggtccgtacgggg

SEQ ID NO: 61472 - DNA, 732 bp, Homo sapiens
  misc_feature: GYAE6OF01DHSMX.37.14.B03.1.454.CMB.1.raw
  modified_base (227)..(227): a, c, t, g, unknown or other
  misc_feature (227)..(227): n is a, c, g, or t
tcagtagtgtagatcacgaccggtgctcgatttagtgtgagtagttccgcggggggggtctcaggaggcagcgctctcaggacatctccaccatggcctgggctctgctgcctcctcaccctcctcactcagggcacgaggtcctgggccagtctgccctgactcagcctgcctcgtgtctgggtcctcctggactagtcatccacatctcctgcacgtcggaaccnagtgtacgttggtagttatactatgtctcgttacgtaaccaactactaccaccacggaacctaaaccgtaccccaaactctaacgtagttatttaagtagtacgtacaacgtaaccggccgtacgacgggtcctacgtaacgtcgtcttccttcgtcggtacctacgtaacgtcgacggtaaccaccgaccggtccctccgtaccgacctacgttcgtccgtccggcctacgacggtcgtacggacgacggacgtcgtacctacttacgtttagtcgtacgacgtactacaacgttaactaacgaacggtctacgaccttaacgtaccgttacgggtttccgggtcggtttacccgggggtaaccgggtaccggggtaaaccccggtccgggttacccggttaccccgggtttaaccggttaaccgggttaaccgaacccgggtacccggtaaacgggtccccggtttaacccccggtaccccccgggttcggtttaaaccccgg

SEQ ID NO: 61473 - DNA, 756 bp, Homo sapiens
  misc_feature: GYAE6OF01DE0QU.37.14.B03.1.454.CMB.1.raw
  modified_base (147)..(147): a, c, t, g, unknown or other
  misc_feature (147)..(147): n is a, c, g, or t
  modified_base (537)..(537): a, c, t, g, unknown or other
  misc_feature (537)..(537): n is a, c, g, or t
tcagtagtgtagatcacgaccggtgctcgatttagtgtgagtagttccggcgggggggtctcaggaggcagcgctctcaggacatctccaccatggcctgggctctgctgctcctccaccctcctcactcgagggcacgagggtccncgggcccagtcctcgccctgactcacgcctcgccgtcgtgtcgtcggtcctcgtacggactagtacactaccaacctctccgttccgcgacctacggaccggaacccgtgtaggtcggttcggtttgggttaagttaactaacgttgttcgttcttccgtaacgtaaccaactaccgaccaaccggaagtaaaccctaaaccctaacctaaacgtctaagtagtttaatttagacggtaaccgaaccgtaaacccgtacccggtccgtacgggtacgttacctaacgttaccgtctttcctttcgtcgtaccgtaccctaacgtacgtccgacggaacctaaccggtccccgtccctaaccgccgtaactccgttaccgtcggtcgtccnccggacgtacgtacgaacggacgtccgtacttacgtactttagtcgtacgactaccgtataactacgttaacaacggactacgaacgttacgtacgttacgtcggggttacgggttccggtaaccgggaccggtaaccggttacccgtaccggtttcggaacccgttcggtaccgaccgacccggtacgaccgtacccgtcccgtcccggtacgtcccg

SEQ ID NO: 61474 - DNA, 669 bp, Homo sapiens
  misc_feature: GYAE6OF01CX3UE.37.14.B03.1.454.CMB.1.raw
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctcctcactcagggcacgagggtcctgggcccagtctgccctgactcagcctgcctcgtgtcgtgggtctccgtggacagtcgatcacctatcctcctgccactcggaacccgnagtgtacgttggtgttanaactatgtcttcttggtaaccaacactcacccaggaccaaacgtaccccaaactcattgatttangaggtaccaacgtaaccggccctgtacgggtctacgttaagtcgtccttctcgtcggtacctccgtaaacgtcgttcggactaaaccgacccgggtaccctccccgtacgaaccacgttcctacgtcgggcctccgaggccgttagaccgaggacggtcctacgtaacgttatttagtcgtacacgtactactaagttaactaacgaacgacgtacgactaacttaccgtacgggtttcggggttacggttaccggggaccgggtaacgggtacccggtacgtacgggtacccgttacgttacggtaccgacgtacccgtaacggccgtacccgccccggtcggttaccccg

SEQ ID NO: 61475 - DNA, 579 bp, Homo sapiens
  misc_feature: GYAE6OF01CM35N.37.14.B03.1.454.CMB.1.raw
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgattttatgaggtcaactaaacggccctcgaggggtctctaatcgctttctctgctccaagtctggacacacggcctcctgaccatcnctgggctcagctgacgagagctnactattattgcagtctnatatacaagcagcatcagttggtggttcggcggacggaccgtaccgtgacccgtcgttacgtccgtacgacccgaaggtcctacggaccccccgttcggtaccctaccttcccgttccggttcccccgtccccgttcccttccgacgttaccttacctaccgttaacgttccggaacggccggggtcgtacgggg

SEQ ID NO: 61476 - DNA, 835 bp, Homo sapiens
  misc_feature: GYAE6OF01CUJ8H.37.14.B03.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (381)..(381): a, c, t, g, unknown or other
  misc_feature (381)..(381): n is a, c, g, or t
tcagtagtgtagatcacgaccggtgctcgatttagtgtgagtagttccggggactttgcctgggctctgctgctcctcaccctcctcactcagggcacagggtcctgggcccagtcctgccctgactcacgcctcgcctccgtgtcgtcggtctcgtggacagtcgatcacntcgtctgctacgcggaaccnagtgtacgttggtagtataactatcgtctgtacgtacatactcgaccgtagaccaaaccgtcccaaatcatagtattagtaggacgtacgaaccgtaaccggtcctcggacggtacctataacgtcgtacttcgcgtacgctactacggtacacgtacgactccgtcctacgttacacctacgttccgnggttaccgacgtaccgacggttcgaccggaacgacgtacgtactaccgtaagttacttacggtcacgtacgtaccgtaataacgtttaaccgaaacggacgtaccgtaacgggttacccggttacggttaaccgggggtttaccgggtacggggttaaccggggacgggtaaccccggggtaaacccttaccggttacccgggttaacccgtttcgggaaaccggttcccggtaaacccggtaccggttaacccggggtcccccgttaacccccgtaccccggttaccgggtccctttaacccgttcccggtttaccccccgtaaccccccgttttaaccccgggtacctttaccggttaacccccgtttaagtacccccgggtttaaccggtaccgggtttaaccccgggtaacgggttccggggtttaaaccggtacccgtaaacggggggg

SEQ ID NO: 61477 - DNA, 782 bp, Homo sapiens
  misc_feature: GYAE6OF01D9P9Z.37.14.B03.1.454.CMB.1.raw
  modified_base (293)..(293): a, c, t, g, unknown or other
  misc_feature (293)..(293): n is a, c, g, or t
  modified_base (387)..(387): a, c, t, g, unknown or other
  misc_feature (387)..(387): n is a, c, g, or t
  modified_base (459)..(459): a, c, t, g, unknown or other
  misc_feature (459)..(459): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctcgtgtcgtgggtctcctggacagtcgatcaccatctcctgcacgtacggaaccgcaggtgtacggttggttagttataactattgtcttaccgttaggaacctaacataccgaacccaggtaccaaaccgtacccaaaactcaattgtaattttacnggaacggtacaaccgtaaacggccctaggacgggtcttactaacgttcgtcttctcgtcggcctaccagtcaggacaacgaccggtccctaccngtaacctcgcttcgtagggtccaccgtaaggcgtacgaccgaggtacgcctataacttatgtacgactaacncttacaagttaactaacaacgtacaagtcctaagttaccgttacgggtttggggttaccggttacggggacccggggtaacgggtacccgtaaccggttacgtaacccggttaccgtttacgggacccgtaaccggtaccccgtaacggggtacccctacccgggttaccccccggtagggttaacccccttaccggttacccgttacccccggtttccccccgtaccccggttaccccttccgttaaacccttacccgtttaaaccccgtaacttacgggtacccggggtaacggggtcccgggttcccggtaaaccggggg

SEQ ID NO: 61478 - DNA, 718 bp, Homo sapiens
  misc_feature: GYAE6OF01DY0IY.37.14.B03.1.454.CMB.1.raw
  modified_base (163)..(163): a, c, t, g, unknown or other
  misc_feature (163)..(163): n is a, c, g, or t
  modified_base (197)..(197): a, c, t, g, unknown or other
  misc_feature (197)..(197): n is a, c, g, or t
  modified_base (489)..(489): a, c, t, g, unknown or other
  misc_feature (489)..(489): n is a, c, g, or t
tcagtagtgtagatcacgaccggtgctcgatttagtgtgagtagttccgggacgttgctagggctctgctgctcctcaccctctcactcgaggcacgaggggtccctgggccctagtctcgccctggacctcagcctgcctccgtgtctcgggtctctggacngtcgatcactactcgtcctgcacgtcggaacccntagtcgtacgttggtacgttaactaacttgtgtccgtacttacggtaaccaactctaccaacccgtaggactaaacccggtaccccgaaaatcagtgtatttaagacgtacgtactaacgtaaccgtcctagaggtctactacgtcgtactttctacgtcgtcctaccgtaagtctaggtaccaacgtcccggtcctacctaccgtacctcgtacgtcgtcggacctaccggacgtccgtacggtacggtacggtcggtactactaacgttatttagcgtacgaccgtactntaactacgtaacacgtcaactctaacgtcgtacggtttggtcgtacggaccgtaggacccgtactcgtacggttcttaacggtacctacggtaacctaggtaccttcccggtacccctacggttacccgttccgtacccgtttacccgttaccccgtcccgtcgttaacccggtaacgttcccgtaaagttaccgtacgggtaccggtgggtaccggtcggaaaccggg

SEQ ID NO: 61479 - DNA, 716 bp, Homo sapiens
  misc_feature: GYAE6OF01AN1OV.37.14.B03.1.454.CMB.1.raw
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctgccctgactcagcctgcatccgtgtctgggtctcctggacagtcgatcaccntcctcctgccacgtcggaacccnctaggtcgtacggtttggtaggttaactaacttatgtcttcgttacggtaaccaactactaccaacccgaggtaccaaaccgtccccaaacttctaatgtaatttagtacgaacggttaccaaccgtaaaccggtccctacggtacggggttccttacgtaacgtccgttctttcctcggttacggtaccgtaccgtaacggttcgtacggaacctaacccgaccggtccccttaccctacgaaccctacgttccgtacgtccgggtacctccgacggtccgtaggaccgacggtacgtcctacgttaacttagttactacgacgtacgtctactaagttaaccaacgaacgtacgactactacttacgttacggttggggttacggttcgggacgggtaaccgggtaccctaccggtacggtacccggttacgtacggtacgtacccggaccgtaacgggcccttacccggtccccgttaccgg

SEQ ID NO: 61480 - DNA, 829 bp, Homo sapiens
  misc_feature: GYAE6OF01E5VO6.37.14.B03.1.454.CMB.1.raw
  modified_base (221)..(221): a, c, t, g, unknown or other
  misc_feature (221)..(221): n is a, c, g, or t
tcagtagtgtagatcacgaccggtgctcgatttagtgtgagtagttccggggactttggcctgggctcgtgctgcctcctccaccctcctcacctcgagggtcacgagggtcctgggcccagtctgccctgactcgagcctgcctccgtgtcgttgggtccttccgtggacgtaggttccgatcaacctattaccgtccgtgcctacgtacgggaacccgntaggtggtacggtttggtaggttaactacgtagtgttcctcgttacggtaccaacgtcgtcctaccgagacctaaacgtcccctaatcatagatttagtggtacgtaactaaccgtaaccggtcccgttacgtacgggtccttacgtaactcggtcctttcgtcgtcggtaccgtacgtacggtcgtcggacctacgtaccggtccctaccgtacgacctacgttccgtcggtcggtaccctacgtaggtacgtacggaccggaacggtacgtaccttacgttaacgttaagttacgttacggactacggtaccttacaacgttaacgtaaccgaacggtaccgtaacgtaacttaacgttacccggttaacgggtttgggtaccgggtacgggtaccggggaaccgtaacccggtacgttaaccgggttcccgttacggttaccgggtaaccgaccgggtaccccgtaaggtccccgttacccggtcccccggttccgttacccgtaccgttcccccggttccggttacccccctaccttacccgtacgttaccgtaacctacccggttacgtacggttccggaacgggtccgggtacgtaccgggg

SEQ ID NO: 61481 - DNA, 698 bp, Homo sapiens
  misc_feature: GYAE6OF01DA1SQ.37.14.B03.1.454.CMB.1.raw
  modified_base (350)..(350): a, c, t, g, unknown or other
  misc_feature (350)..(350): n is a, c, g, or t
  modified_base (651)..(651): a, c, t, g, unknown or other
  misc_feature (651)..(651): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccagacaaacgtaccccaaactcatgtatttatggacggtacaaaccgtaaaccggccctacgaggtactttactaactccgtctttcctctcggctacctaagtctggacaaccncggcctcctgacctatctcgtggcctaccgacgtgacggacgacgtactctacttattagtcgcacgtctactataaagtaaacgcgacgtcgtacgtacggttgggtcggttcgggaccgggtaacggacccgtaccgtcggtaccgttacgttacggaccgtaccgaccccggtaaggtcccgttcccggccccccgttacgggtccctaaccgttccccgttacccggttaccccccctaccccgtttacccttacccgtaacctttaccccgttaaacccgtaaccgtttacccggnggtaacccggggccggggtacctaccggggaccggtaaaccggtccg

SEQ ID NO: 61482 - DNA, 616 bp, Homo sapiens
  misc_feature: GYAE6OF01DP034.37.14.B03.1.454.CMB.1.raw
  modified_base (189)..(189): a, c, t, g, unknown or other
  misc_feature (189)..(189): n is a, c, g, or t
  modified_base (601)..(601): a, c, t, g, unknown or other
  misc_feature (601)..(601): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttcggtaaccaacatccacccaggaccaaacgtccccaaatcatgtatttatgaggtcactaacggcctacgacgggtctactaatcgctttctctcggtcctacctaagtcgtggccaacgtacggccctccctcgaccactctcgtggctcgaggctcggtacgacgacggctactacttattatcgactagtcctacgatataacgaagcaagctatcgtcgtttagggtcggtcggtcgggaacggaccgtactcggtacccgttcgtaacggttcacgacccgacgtacgtccgccccgtaccggttctccgttaccgttccgttaccccgcccttcccgttcgaacccttcctaaaccgtaccttaacgcgggtacncggggtcctacgggg

SEQ ID NO: 61483 - DNA, 600 bp, Homo sapiens
  misc_feature: GYAE6OF01A13CL.37.14.B03.1.454.CMB.1.raw
  modified_base (230)..(230): a, c, t, g, unknown or other
  misc_feature (230)..(230): n is a, c, g, or t
  modified_base (325)..(325): a, c, t, g, unknown or other
  misc_feature (325)..(325): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaaccaanatcacccaggcaaagtccccaaatcatgatttatgaggtcactaaaccggccctgagggtctctaatcgcttctctggcctcaagtctggcaacnccggcctccctagaccatcctcgtcgggcttccgaggctggacgacgaggctacacttattagttcgcagctactatactacaagcaagctatctacgtttggggtcgttccgggacgggacgggaccctaccgtcggtaacccgttgttacggtaccgaacgtacccggaaggtcccgtccgtccccccgtcggtcctaccgttccgttacccgttccccctaccctcctacctacttacctaacctacttacgaggtacggtcgggctacggg

SEQ ID NO: 61484 - DNA, 794 bp, Homo sapiens
  misc_feature: GYAE6OF01D7K1X.37.14.B03.1.454.CMB.1.raw
  modified_base (269)..(269): a, c, t, g, unknown or other
  misc_feature (269)..(269): n is a, c, g, or t
tcagtagtgtagatcacgaccggtgctcgatttagtgtgagtagttccggcgggggggggtctcaggaggcagcgctctcaggacatctccaccatggcctgggctctgctgcctcctcaccctcctcactcagggcacgagggtcctcgggcccagtctcgccctgactcagcctgcctcgtgtcgtcggggtcctccgtggactagtcgatccacctatcctctgcacgtcggaaccagcagtggtacgtttggtagttaattaatntcgttctcgttacgaaccaaactctaccaacccaactactacccaacccgaacggtaacctaaaaaccccgtaccccaaaacttactaaattttaaacgttttatacggtaacggttaccaaaaccgttaaacccggccctaggtaacggttaacgttttactaacgttccgtactttactcgttacgtaccttacgaacgttcgtacggaccaaaccgtcccggtccccttaccgtactaccctacgttccgtcggtccggacccttaccgggaccgtcgtaaccggaaccggtaccgggtacgaccgttaccttaacttttaatttcgttaccgcgaacgtcctaataacgttaactaacgaacacgtacgaccttacgtacggttccgggtttacggggttcgggtaacccgggggtaccggggtaaacccggacccgggttacccggttacccgggttaacccggtttaccgggtttaacccgggtaccaacccggggtcccggtaacccgggtcccccgg

SEQ ID NO: 61485 - DNA, 540 bp, Homo sapiens
  misc_feature: GYAE6OF01ATTV0.37.14.B03.1.454.CMB.1.raw
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (439)..(439): a, c, t, g, unknown or other
  misc_feature (439)..(439): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtgttatactatgtctcttgtaccaanatcaccaggcaaacgtaccccaaactcatgtatttatgaggtacaactaaaccggccctcgacgggtctactaatcgtcttctctcggctcaagtcgtggaccaaccgaccggccctccctgacctactctcgtgggcctccgagctcgacgacgacgctctacttattattcgcncgtctacaatacaacaagcagacatctacgttgggtcgttcggcgggacggaccgacgtgaccggtctacggtcacgtccacggctccgcccgtcggtacc

SEQ ID NO: 61486 - DNA, 575 bp, Homo sapiens
  misc_feature: GYAE6OF01BJ29S.37.14.B03.1.454.CMB.1.raw
  modified_base (188)..(188): a, c, t, g, unknown or other
  misc_feature (188)..(188): n is a, c, g, or t
  modified_base (399)..(399): a, c, t, g, unknown or other
  misc_feature (399)..(399): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccncagtgacgttggtggttataactatgtctcttggtaccaacatcacccaggcaaacgtccccaaactcatgatttatgagtcactaaacggcctgagggtctctaatcgcttctctggctccaagtctggcaacacggcctccctgaccatctcgtggctccgaggctgacgacgaggctcactattattgcagtctacatatacaagcancatcgtacgtttgggtcgttcggcgggacgggacccgtaccgtcggtaccgtcgttaggccacggacccgaacggcccgtccgtcccccgtcggtacctccgtccttccggttacccctacccttcctccacttaccctaaccgtacctaccgtaggacgtccgggtcgtaccggg

SEQ ID NO: 61487 - DNA, 711 bp, Homo sapiens
  misc_feature: GYAE6OF01B1AEX.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtgttataactatcgtctcttggtaaccaacactccacccgaggacaaacgtaccccaaactcactagtatttatggtagtacaaccgtaaaccggccctcgagggtcttactaatccgtctttcctcgtcggtcctaccgtaagtccgtcggaccaacgaccggtccctaccctcgaacctactccgtcgtcggcctccgacggctacggaacgacggacgtctactaacttattacttcgactacgcttacataacgtacaagtacaacgtactacgttaccgtacgggtttcgggttccgggttaccgggaccggggtaaccggggtacccggtaaccgtcggttaacccggtttacggttacggtaccgtacccggacccgtaacgggtccgtccccgtccccggttaccgtaccgttcccgttacccgttcccgttccccgtaccccttcgtcccttaccgtccttaacctaccgtacccgtaggccggtaccgggccgtaaccggg

SEQ ID NO: 61488 - DNA, 698 bp, Homo sapiens
  misc_feature: GYAE6OF01EF4NB.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgactcaccatctcctgcactggaactcgctagtgtacgttggtgttataactatgtcttcttagtaccaacactccacccgaggacctaaacgtacccccaaactcatgtaatttagtagtacggtaccaaccgtaaaccggccctacggagggttcctacttaactcgtccttctcgtcggtcctaccgaacgttccgtcgaccaaccgtacccggtaccctaccctagaacctacttcctcgtcgggtcctacggacggtcgtagggacggacgtacgggtcttacggtaacttttacgttacgtcgtcttacgcttacgtatacgtacgtacgtaggtactaccttacgtttacttacgtcgtttaccgtaacgggtacgtaccgggtaaccctacggtacctaacccggtacttaccgtacaaccgtacccgaaccgacccctaacccgtgtacctaccgtaccttccttacccgttaccccaccgttccctaacctacttaccgtaacctacgaccgttgcggtccggtacg

SEQ ID NO: 61489 - DNA, 776 bp, Homo sapiens
  misc_feature: GYAE6OF01DHF1K.37.14.B03.1.454.CMB.1.raw
  modified_base (190)..(190): a, c, t, g, unknown or other
  misc_feature (190)..(190): n is a, c, g, or t
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
tcagtagtgtagatcacgaccggtgctcgatttagtgtgagtagttccggggactttgcctgggctctgctgctcctcaccctcctcacgtcagggcacagggtcctgggcccagtctgccctgactcagcctgcctccgtgtctgggtctcctggacagtcgatcaccatctcctgcactcggaacccncagtgtacgttggtgttataactatgtctcttaggtaccaactactcaaccaggaccaaacgtacccaaatcattgtatttgngaggacagtaagcggcctcgtagggttactatcgtctttctntgctcgagtntcggcaacncggcctcctgactactctcgtcggcctacgaggtcgtaggaacggacggtacggtacttagtaacgtttattacgtgtccttagtccttactagttacgtacggtacgtaacgggttacttaaccgtacctttacgtttacgttacggttaccggtttaccgggtaaaccgttacgggggtaaaccccttaagggttacccgtaacccggttaccgttaaaccggtaccgaacccgggttaacccccgaaaccgggtacccccctaaccccgttaaccgttacccggtttaccgtacccggtttaccccgtttccccgggttaacccccccgtaccccgttttaccccgtacccttaaaccctttaccccggttaaaaccccttaaccggttaaccggtaccgggtaaaccgggggtcccgggtaccggttaacccgggggg

SEQ ID NO: 61490 - DNA, 630 bp, Homo sapiens
  misc_feature: GYAE6OF01A2V6Y.37.14.B03.1.454.CMB.1.raw
  modified_base (222)..(222): a, c, t, g, unknown or other
  misc_feature (222)..(222): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcatcaccatctctgcactcggaccnagtgacgttggtagttataactatgtctcttaggtaccaacatcacctaggacaaacgtccccaaaactcatgatttatgaggtacacttaaacggcctcgagggtctctaacgtctcttctcgtgtcctcagtctcggactaaccgacggcctcccgtagacccattcctcgtcggccttccgaggtctacggaccgtacggaggtcctacgtaacttagtttaacgtcgacaacgtctacgaacttactaacgaacgtacagactaacgttcgtaacggttggggttacggtccgggacgggtacgggaaccccgtaccggttacggtacccggtttcgtttaaccggccgaaccgggttaccccggaggttaccccgtccccgtcccccggttacggttaccccg

SEQ ID NO: 61491 - DNA, 802 bp, Homo sapiens
  misc_feature: GYAE6OF01CF8BH.37.14.B03.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
tcagtagtgtagatcacgaccggtgctcgatttagtgtgagtagttccgcggggggggtctcaggaggcagcgctctcgaggacagtctccaccatggcctgggctctgctgctcctcaccctcctcactcgagggcacgagggtcctgggccctagtctcgccctgacctcacgtcctgtccctccgtgtcgtcgggtctccgtggacngtcgactcaccatctccngcacgtcggaaccngagtgtacgttgtgttaatatatgtcttcgtcgtaaccacactaccaccgacgactaaccgtacccaactacgatagtatttagacgtacgtactaacgtaaccggtcccgtacgacgggtcctacgtaactcgtccttaccgtcgtacggtacctaccgtaacgtccgtacgaacaaccgtaccgtacccgttccgtacgaaccgttacgtccgtaccgtccggtaccgtccgtagggtcctacggaaacccggaggaccgggtcctaaccgtactttaagttaccgtcgtaactacccggtactaccgtaacgtaaccttaaccggaacgtaccgtaacgtacccttaaacgttccgggttacggtttacgggggttacccgggttaccgggggtaaccgggggttaaaccccggggttaacccggtacccgggtttaacccgttaaacccgggtttcccgggttaaccgggtaccccggtaaacccgggtaaccccgggtaaacccgggtcccccggttaccccggtccccccgggtttaaaccccggttacccccg

SEQ ID NO: 61492 - DNA, 832 bp, Homo sapiens
  misc_feature: GYAE6OF01DJAGM.37.14.B03.1.454.CMB.1.raw
  modified_base (174)..(174): a, c, t, g, unknown or other
  misc_feature (174)..(174): n is a, c, g, or t
  modified_base (231)..(231): a, c, t, g, unknown or other
  misc_feature (231)..(231): n is a, c, g, or t
tcagtagtgtagatcacgaccggtgctcgatttagtgtgagtagttccggggactttgcctgggctctgctgctcctcaccctcctcactcgagggcacgagggtcctgggcccagtctcgccctgactcagcctgcctcgtgtcgtgggtctcgtaggacaggtcatcacctntcctccgtgcacgtacgggaacccgctaggtacggttaggtttggttaggtttaaanaaattgttgttccttacgtttacggtaaccaactactacccaaaccaacgtactccgaacccgaaggaaccctaaaaccgtaccccctaaaactactaaagttttaaattttacgtggtaacggtaaccgtaaaccgttaaaccccggggtccctacggtaacgggtttaacgtttttacctaaacgttccggttccttttcgttcccggttacgtaccgttaccgtaacgttccggtaccggaccgtaaacccgtaccccggttcccttaccgaccgtacctacgttccgttcggcggttaccctacgaacccgtgggaacggacgacggtcttacctaagttattcgtagcgtactcgtactaagtaactaacgacgtacgacgtacgttacgtccgggtttgggtaccggtaccgggacgggtaccggttaccggcgttacggtacccggttagttaccggacgtacccgaccggttaaccggtcccgttcccggaccccgttcggccttaacccgttcgtaccccgttccccggtaccttcccgttacgtacccttaccgttaccgtaaccgttcggacggcgggtacgggtaccgg

SEQ ID NO: 61493 - DNA, 759 bp, Homo sapiens
  misc_feature: GYAE6OF01CQA94.37.14.B03.1.454.CMB.1.raw
  modified_base (472)..(472): a, c, t, g, unknown or other
  misc_feature (472)..(472): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggttcctctggacagtcgatccaccattcctcctgcctacgtcggaacccgtcagtcggtacggtttggttaggttaactaaccgttattcggttccttcgttaggtaaacccaaacgactaccaacccgaaggacctaaaaccggtaccccaaaactctaagttcgttaactttaagtacggtaacggtacctaaacccggtaaaccggcccttacggtaagggttcttacttaacgtccgttcttaccgtcgtaccgtactacctaacgtcgtacggaccaacgcccggtccctccgtacaccgtagttcctcggtcgggtaccncgacggtactaggaccggaacgcgtactaacgtaactaggtttactcgctacgtctactaactaagtaaccgaagtacgtacgtacctactaccgttacgggttacgggtcggtaccggggtccgggaccggtaacccgtaccggtacgtaccgtaacggttacggacgtacggaccctaacggtcctaccgtccccgtctacccgtacgtccttacccgtccctaaccctccctaccgtacttacccgtactacccgttaagacgggtccgtcggtcggtaccggg

SEQ ID NO: 61494 - DNA, 593 bp, Homo sapiens
  misc_feature: GYAE6OF01B8U5I.37.14.B03.1.454.CMB.1.raw
  modified_base (227)..(227): a, c, t, g, unknown or other
  misc_feature (227)..(227): n is a, c, g, or t
  modified_base (372)..(372): a, c, t, g, unknown or other
  misc_feature (372)..(372): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctctgcacgtggaacccnagtgacgttggtgttataactatgtctcttggtaccaacatcacccaggcaaagtcccccaaactcatgtatttagtgaggtaccaacgtaaaccggccctacgaggggtctactaactcgtcttctctggcctccgaagttcgnggaccaaccgtacggcccttcccgtacgaccctacttccttcgtcgggcctccgacggtctacggaaccggacgcggcctacgtaacttacgttattcgcacggtctactaataactaacaagcagctatcgtacgttgggtcgttcgggcggacggacccgaccgtagtacccgtcgttacggacacgtcccgaaggcctcccgtccccgtcggtacccg

SEQ ID NO: 61495 - DNA, 630 bp, Homo sapiens
  misc_feature: GYAE6OF01C5QNJ.37.14.B03.1.454.CMB.1.raw
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgtacgttggtaggttataactatgtctcttaggtaaccaacatccaccaggacaaacgtaccccaaatcatgtatttatgaggtacaactaacgcctgaggtctactatctacttctcgtgcctcgagtcgtgaccaacnccggtcctccncgacctctctcgtggcctcgagctacgacgacgcgctacatttattatcgacacgtctactaagtaactaacgaacacgacgactacgttccgtaacggttttcggggttcggtaccggggtacgggaaccgggtacccgtaccgtacggtaccgtttacgtacggtacgaccgaccgtacgtcgtcccgtaccccgtcgtaccctacgttcccgtacccgtcccctacccgttcctaccgtaccttacctacctaaccgtacgtaggccggtcgggcgtaaccggg

SEQ ID NO: 61496 - DNA, 817 bp, Homo sapiens
  misc_feature: GYAE6OF01DH3CC.37.14.B03.1.454.CMB.1.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
  modified_base (298)..(298): a, c, t, g, unknown or other
  misc_feature (298)..(298): n is a, c, g, or t
tcagtagtgtagatcacgaccggtgctcgatttagtgtgagtagttccggggactttgcctgggctctgctgctcctcaccctctcactcagggcacagggtcctgggcccagtctgccctgactcagcctgcctccgtgtcgtggtctcctggacagtcgatcactatctcctgcactcggaacccgntaggtgtacgttggtagttaactaactntcgtacttcgttacggaaccaactacgtccaaccgaaggacctaaaacgtaccccaaatcgtaagttacgtaagttttagnggtaacggttacaaccgtaaccggcctagtaggttactttacctaatcccggtctttacgtacgtacgaccttaacccgtaaggttccgtacggaacctaaacccgtccggtaccccgtcctaaggacccttagttaccgtcggtaccggtactaacccgaccggtaggacggacgtacggtccttaacctaatttaacgttagttcggactagtactaactaagtaactaagaccgtacgtacggtcgttaacgtggtttacgggtaccgggttacgggaaccgggtaccgggaacccgtacggtaccggtacccgttacgttaccggtaaccaaccggtacccggtaacggaccccgttacccggtccccgttacgggttaccctaaccggttcccgtaccccgtttaacccgtaccccgtacggtttaccctaccgttacccgtaaaccgttaaccgttaaaccgggtccgggtaaacggttccccgggacggttaccggaaaccgggtaacccgg

SEQ ID NO: 61497 - DNA, 914 bp, Homo sapiens
  misc_feature: GYAE6OF01EYGNN.37.14.B03.1.454.CMB.1.raw
  modified_base (255)..(255): a, c, t, g, unknown or other
  misc_feature (255)..(255): n is a, c, g, or t
tcagtagtgtagatcacgaccggtgctcgatttagtgtgagtagttccggcggggggggtctcagggaggcagcgctctcaggacatcctccaccatggcctgggctctgctgcctcctccaccctcctcactcgagggcacgacgggttccgtcgggcccagtcctcgcccctgtacctcacgcctgtccctccgtgtcgtggtcctccgtcggacaggtcgactccacctatcctcctgcacctcggaccccngagttcgtacggtttggttaggttaataactagtcgttcctaccgttacgtaacccaactactacccaacccgacgggtaacctaaaaccccgtaaccccctaaacgtcaacgtttacgttaagtttaacgacggtaacggtacctaaacccggtaacccggtcccgttacgggacgggtttaccttaacgtacgttccgtcgtttaccgtccgttacgtccctaacgtaacgttcccggtacggaacccgtaaccgtaccccggtaccccttacccggtagttaacccgtaacgttcccgttacggtcccgggtacccttacccgggaacgggtaccgttacgggaaaccggggtaacggtaacgggtttaccgttaagtttaaccgtttttaacgttaccgtacgtccggttacgttacgttaccttaaggttcctaacgggtaccgttaagggttaaccgttaaccttacttttacggtttacgtttaccgggttaaccggtttaaccggtaaaccgggttaacccggtaacccgggttaacccggttaacccgtaaacccggtttaccccggtaaacgttacccggaaaccccggttaaaccccggaaccccgttaaacccccgtaaaccccgtttaccgttcccgttaaccccc

SEQ ID NO: 61498 - DNA, 642 bp, Homo sapiens
  misc_feature: GYAE6OF01EQZ04.37.14.B03.1.454.CMB.1.raw
  modified_base (189)..(189): a, c, t, g, unknown or other
  misc_feature (189)..(189): n is a, c, g, or t
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
  modified_base (563)..(563): a, c, t, g, unknown or other
  misc_feature (563)..(563): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcatcaccatctctgcacgtacggaacccncgagtgtacgttggtaggttataactatgtcttcgttcgaaccacactccacccgaggaccaaacgtaccccaaactcatgtatttagtggtaacgtactaaccgtaaacgccctacggacgggtcctactatcgtcttcgtcgtcggtctcgaacgtcgtcggacacgccgtcctccgntaccatccgtcgtacggctccgaggctacggacgacgngcctactaattattacgtcgacacgtactactagtaactacgagacacgactactccgttacggttgggtcgggtaccgggacgggtaaccggcccgtacgtccgttaccggttaggtaccggaccgacgaccccgtaggtcccgcccggtcccgngacccgttaccttccgtcccgtcccctaccccttcgtacctaccgtacttacgtctacggcgcgggtcggcgtaacggg

SEQ ID NO: 61499 - DNA, 708 bp, Homo sapiens
  misc_feature: GYAE6OF01DHR9C.37.14.B03.1.454.CMB.1.raw
  modified_base (623)..(623): a, c, t, g, unknown or other
  misc_feature (623)..(623): n is a, c, g, or t
tcagtagtgtagatcacgaccggtgctcgatttagtgtgagtagttccggggactttgcctgggctctgctgctcctcaccctcctcactcagggcacaggtcctgggcccagtctgccctgactcagctgcctccgtgtctgggtctctggacagtcgatcacatctcctgcactcggaacccgcagtgtaacgttggtaggttaataacttatgttcttcgttaggtaacccaactactaccacccgaggacctaaacgtacccccaaatcaattgtattttagtcggacggtaccaaacgtaaaccggccctagaaggtagtttaccaagtccgtctttactcgtggtcctacgtaagtcgtacggaccaaccgccggtccctccgtacactctccgtcgttcggaccttacgaggtctaggacggacgtacggtcttagtaactttacgttacaggtcctcgtactacgtaagtatcgggtacgtaacggttactaccgtactttagtttaacgttccgggttaaccgttaccggaaggtttaccggaaccctaagggttaccttaacccgtaggttaaaccgtccgaacccggtacccaacgggtcccctaacccggngttacccggactaccgttccgtacccttaccccgtccttaccttccgacttacctaacgtccgtatcgggaccggcgttgaccgg

SEQ ID NO: 61500 - DNA, 705 bp, Homo sapiens
  misc_feature: GYAE6OF01CUJD5.37.14.B03.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (265)..(265): a, c, t, g, unknown or other
  misc_feature (265)..(265): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcacatctcctgcactggaacccncagtgacgttggtaggtataactatntctcttggtaccaacatcaccaggaccaaaacgtccccaaatcatgtattangacgtacaccgtaaacggcctcgagggtctactaactctcttctctcggcctaccgaagtcgtaggaccaacgaccggtaccctccacgtaccacttctcggttcggacctacgacggacgtacgaacggacgacggtaccttagaacctttattacgtacgactacggtaactactaactaactaaacgtaaacgactaacgacctaagtacccggtttacggtttaggggtccggtttaccggggaaccggggtaaccgggtacccgtaaccgttacggtaacccggtttcgttaacggtcccgaacggtcccgtaacggtcccgaccgttcccccgtacggtcctaccgtttcctaccccgttaccccgacccttacccgcctacgttaccctaacgttacccttaacggtaggtcccgggtaccgggtggtaccgg

SEQ ID NO: 61501 - DNA, 710 bp, Homo sapiens
  misc_feature: GYAE6OF01CMDK0.37.14.B03.1.454.CMB.1.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (476)..(476): a, c, t, g, unknown or other
  misc_feature (476)..(476): n is a, c, g, or t
tcagtagtgtagatcacgaccggtgctcgatttagtgtgagtagttccggcggggggggtctcaggaggcagcgctctcaggacatcctccaccatggcctgggctctgctgctcctcaccctcctcactcagggcacagggtcctgggcccagtctgcccctagactcagcctgccctcgtgtctgggtcctcgtggacngtcgatccaccatcctccgtgaccacgtcgggaaccccngtagtcgtacggttggtacgtttaataactgttgtcttcgttacgtaccaacactaccaacccgacggaaccaaaaccgtacccccaaaatccgatagttacttagtacgacgtaaccaaccgtaaaccggcccgttacggtacgggttacctacgtaacgtcgttcctttcgtccgtacggtccctaccgtaacgtcgtacggaccaaccgccggtccccttccgtaacgacctnttccgtcggtcggtccctccgacggtcctcggacgaccggacgtccgtactacttaacttaacggtcaccgtacgtaccgttaactaaactactaacgaaacggtcaacgtccttacgtaaccgtttcgggttacgggttcgggtaccgggtacgggaccgggtacccgttaccggtcgtaaccgtcggtttacgccgtaaccgccgaacggccctcccggcccgttccggtcc

SEQ ID NO: 61502 - DNA, 766 bp, Homo sapiens
  misc_feature: GYAE6OF01EFOGP.37.14.B03.1.454.CMB.1.raw
  modified_base (293)..(293): a, c, t, g, unknown or other
  misc_feature (293)..(293): n is a, c, g, or t
tcagtagtgtagatcacgaccggtgctcgatttagtgtgagtagttccggcgggggggggtctcaggaggcagcgctctcaggacatctccaccatggcctgggctctgctgctcctcaccctcctcactcgagggcacgagggtcctgggcccagtctcgccctgactcagccctgcctccgtgtcgtcgggtcctcgtggacagtcgatccacctactcctccgtcgacctacgtacggaaccagcagtgattatagtaaacttataaccttgtctacttacgaaccaacncgaccaccgaacgaccaaacccgaccccctaaatccaagttagtacgtttggacgaacggacgtaacggtaacggcccgtacccgttaggtacgggtttacctaacgtccgttaccttcgtccgtcggtaccgtaccgtacgtccgttcggaaccaccgtacccgtccctacccgtacgaactaccttcgtcggtaccgctaccgcggtacgtcgggaacggacgggtacgtacgttacgttaattacgttacgtcgttcgtccgtacttacgtaacgttacggtaccgtacgggtaacggtttaccgttacttacgtttactttcggtaccgtttaccgggttaaccggaaccgggttaccggtaaccggttaacccggttacgttaaccccgggttaaccgtacggttaaccccggaacccgtaaccccccgaaccgggttaacccccctaaacccgggtctaaacccccg

SEQ ID NO: 61503 - DNA, 827 bp, Homo sapiens
  misc_feature: GYAE6OF01C0LTU.37.14.B03.1.454.CMB.1.raw
  modified_base (202)..(202): a, c, t, g, unknown or other
  misc_feature (202)..(202): n is a, c, g, or t
tcagtagtgtagatcacgaccggtgctcgatttagtgtgagtagttccgggactttgcctgggctctgctgctcctccaccctcctcactcagggcacgagggtcctcgggcccagtctcgccctgactcacgcctcgcctcgtgtcgtgggtctccgtaggactagtcgatcaccatcctctgacaccgtacggaacccgntagtcggtacggtttggttaggttaataacgttagttcgttaccgttcgttaacggtaaccaactaccgtaccgaacccgtaacgaacccgtaaaaccgtaccccaaactctaattacgttaatttagtacggtacggtacctaaaacccggttaacccggtcccgttacggtacggggttcttaaccgttaacgttccgttccgtttcctacggtaccggtccttaaccggtaacggtacgtaccggacccgaaacccgtccccgggtacccctacccgtaaccgtaccgttacgttccgtcggtccggacctcggacggtcgtacggaccggacgtcgtacctacttaacgtttaggttctacgacgtactacctacgtaactaacgtaacgacgtacaactacgtcggttacgtttacgggttcggggtcggtaccggggaaccggtacccggtaccggtacctaccggttaccgttcggtacggtaccgaaccgtccggtaaccgtcccgtacccgtcccgttcggtacctcccgttcctaacccccgttccccgtaccctaccgttctaaccctttacaccggttaccgaccggtaggacccgggtcggtaccggtacgg

SEQ ID NO: 61504 - DNA, 857 bp, Homo sapiens
  misc_feature: GYAE6OF01D2RTO.37.14.B03.1.454.CMB.1.raw
  modified_base (151)..(151): a, c, t, g, unknown or other
  misc_feature (151)..(151): n is a, c, g, or t
  modified_base (175)..(175): a, c, t, g, unknown or other
  misc_feature (175)..(175): n is a, c, g, or t
  modified_base (686)..(686): a, c, t, g, unknown or other
  misc_feature (686)..(686): n is a, c, g, or t
tcagtagtgtagatcacgaccggtgctcgatttagtgtgagtagttccggcggggggggtctcagggaggcagcgctctcgaggacatctccaccatcggcctgggctctgctgcctcctcaccctcctcactcgagggcacgagggtccngggccctagtctcgccctgactcncgtcctcgtcccgtcggtgtcgtcgggtcctccgtggaactacggtcgactccacctattccgtacctacgtccaccggtaaccggaaccccgtgtaggttacggtaacgggtttggggttaacgttaataaccttaagttcggttaccttaccggttaccggtaaccctaaaccgtacctaccaacccggtaacggtaaacccgaaacccggtaaccccctaaactaccgtaagttaggttaactttaggttacggtaacgggttaacctaaacggttaaacggtcccggtaccgttacgggtaacgggttcctacgttaacgtccgttcgttcgtacgtcgggtacctaaccgtagtcgtacgacgaaacccgtccgtaaccctccgtaccaactccgtccgtacggtcccggtaccgtacgagggttacccacgggtaacccggtaagtacccgtacctaaccccgtttaagttacgtttacgtacgacggtacctacctaacttaanaaccgtaacgaacgtcgtaagttacctacggttaccggtacgggtttacgggtccgggtaccggggtaacccgggttaccggaacccggttccgtaacccgggttaccttcggtaccggaacccggtaccgtaacccggtacgtaccccgtccccggtcccggttaccccg

SEQ ID NO: 61505 - DNA, 892 bp, Homo sapiens
  misc_feature: GYAE6OF01ECGNK.37.14.B03.1.454.CMB.1.raw
  modified_base (200)..(200): a, c, t, g, unknown or other
  misc_feature (200)..(200): n is a, c, g, or t
tcagtagtgtagatcacgaccggtgctcgatttagtgtgagtagttccggggactttgcctgggctctgctgctcctcaccctcctcactcgagggcacgacgggtccctcgggccctagttcctcgccctagacctcgcgccgtcgtcctccgtgttccgtcggtctccgtaggacagtcactccaacctctccgtccncgacctaccgtaccggaacccgtgtaaggttcggttacggtttagggtttacgttaactaacttgtcgtttcttacgtacgaacctaacgtcacccaccgagaaccaaccgtacctaatcgtatagttacgttagtaggtaccgtacgtaaaccgtaccggccgtacgacggtccttacgttaactccttacgttctcccgtcggtacctcgtaacgtcgtacgaccgaaccgtcccgtccctcccgtactaacctccgtaccggtccgtcggtacctccggacggttacgaccgggtaaccggacggtaacgttcccgttacttaaccggtttacttacggtacccgtacggttaccgtacctttaactaaacgttaaccgtaacgtaaacggtactaacggtttccctaacgggttacccgggtttaacggggtttcggggttaacccgggttccggggaaccgggtaccccgggttaacccgtacggttacccggttaaccggtttaccgtaccggtaccggtaccccggtaccggtaacccgttccccggtaccccgtcccgttaccggtcccgtttacccccgtaccggtttccccggtacccccgttccgtacccttaacccgttaccgtacgttaacccgttccgttacccggtacccgggttcggtaccgtccgggtaaaccgg

SEQ ID NO: 61506 - DNA, 759 bp, Homo sapiens
  misc_feature: GYAE6OF01AYNBO.37.14.B03.1.454.CMB.1.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
tcagtagtgtagatcacgaccggtgctcgatttagtgtgagtagttccggcgggggggggtctgaggaggcagcgctctcaggacatctccacatggcctgggctctgctgctcctccaccctctcactcgagggcacgaggggtcctcgggcccagtctcgaccctgactcacgctcgcctccggtgtcgtgggtcctcgtggacaggtcacttacaacctntcctcctgctacgtcggaaccntaggtcggtacggttggtagttaactaactnttcgtctcgttacgaaccactactaccgaaccgtacggaacctaaaccgtacccctaactctagtacgttattagtacgtacgtaacctaaccggtaacccggtccgtacggtacgggttccttacgtacgttcctcttcgtccgtacggtacctaccgtacgttcgaccggtaccaccggtacccgtccctccgtacgacctacgtccgtcggtcggccttccggggacgtccgggtaacgaccggacgtacggttccttaacggtaacctttcgttaacgtcgtaacggtaactcctaagttaaccgaacgtaaccgacggtaacgaccgttactacgttttaccgggtagggtttccgggtaacgggtacccggggaacgggtacccgtcccggtacggttacgggttcccgtaacgggtaccgtcccgaaccgggtaccctaccgggtccctaacccccgggttcccgtcgtacccccg

SEQ ID NO: 61507 - DNA, 820 bp, Homo sapiens
  misc_feature: GYAE6OF01C1CIJ.37.14.B03.1.454.CMB.1.raw
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtcctaccgnggactaggtcactaccaccatcctccgtgaccagtccggaaccnaggtcgtacggttggtagttaatactgttctcttgtacgaaccaactctaccgacccgacgaacctaaccgtaacccctaactagtaacgtgttagtttagacggtaacgtaccctaaacgtaacccggtcccgtaagggtaccggttctaaaccgttagtacccgttcgttaccgtcgtacggtaccctaaccgtagtaccgtccggaacctacccggtaccgtccccctacccgtataccctacgttccgttacggtccggtccgtaccggtacggaccgttaacgggaaccgtaaccggttaacgtacccttacttaaccgtttaaacgttcgtaccgacttacccgtaacttaacccttaagaaaccgttaacgaaccggttacgaaccggtttacctaacgtttaccggttcgggtttacggggttacgggtacccggggtaacgggtaacccgggtaccccgttaacggtacccgggtttaacccgttcgggtttaacccggacccgttaacccggggtaacccttacccgggccccgtttaccccggtcccccggtttacggtaacccccg

SEQ ID NO: 61508 - DNA, 694 bp, Homo sapiens
  misc_feature: GYAE6OF01BG633.37.14.B03.1.454.CMB.1.raw
  modified_base (323)..(323): a, c, t, g, unknown or other
  misc_feature (323)..(323): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctctcactcagggcacgagggtcctgggcccagtctgccctgactcacgcctgcctccgtgtctgggtctcctggacagtcgactcaccatcctcctgctactcggaacccgcagtcgtaggttggtgttaataactatgtcttcgttacggaccaactctaccaccaggacaaaccgtacccctaactcagtagtagtttagnggacgtactaacgtaaccggtccctggtacgggtctactactcgtccttcgtcgtcgctacagtcgtacgaccaacgtacccgtcctccgtacgacctacgtccgttcggtccggtacctaccggacgtacgtacggaaacccgacggtacgtccgttaacctacgtttaacgtttacgtcgaacgttacgtcgttaactaagtaacgtaaccgaatccgtacgacttacggttacgtacggtttacggggcggttaccgggacggggtaccggtaacccggtcggtaccggtaccggtttccgtaccgggtacccaacggtaaccccggtacggtaccccgttccccggtcccccggttaaccggtcccg

SEQ ID NO: 61509 - DNA, 852 bp, Homo sapiens
  misc_feature: GYAE6OF01DV9B1.37.14.B03.1.454.CMB.1.raw
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
tcagtagtgtagatcacgaccggtgctcgatttagtgtgagtagttccgggggactttgcctgggctctgctgctccccaccctcctcactcagggcacagggtcctgggcccagtctgccctgactcagcctgcctccgtgtctgggtctctggacagtcgatcaccatctcctgcacgtcggaacccgcagtgacgttggtaggttaataactnttcgtcttcgttacggtaaccaanactaccaaccaactactacccgaacccgaacggacctaaaaaccgtacccccaaaacttactaaattaaattttagaggaacggttaaccaaccgtaaaacccggtccccttagaacgggttacgttttactaacttccgtacctttccgtacgtcggtacctaccgtaacgttccgtacggaccaaacccgtacccggtccccttccctaacgacctacttccgttcggtcggcccttaccgacggtcgtagggaacggtacggacggtcttaaggtaacttttacgttacgtcgccttacggtccttaactagttaacgttcggaacggttaacggtttaaccttcccgtaaacttttacggttacgtttcggttaccggttaccggtaacggtacgggtaaccctacgggtaccctacccgttaacgttaacgcccgaaccggtaaccccgaaacccggaccccctaaaaccccgtgtttaaccccggtcctttaacccccgttcccgtttaccccggttacccccccgccccttttaccccgaaccttaaccccgtttaccctaaaccggttaccccgttaacggccggggtaacgggtaccccgggg

SEQ ID NO: 61510 - DNA, 507 bp, Homo sapiens
  misc_feature: GYAE6OF02IKV92.37.14.B03.1.454.CMB.1.raw
  modified_base (501)..(501): a, c, t, g, unknown or other
  misc_feature (501)..(501): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtcccaaactcatgatttatgaggtcactaaacggccctcaggggtctctaatcgcttctctggctccaagtctggcaacacggcctccctgaccatctctgggctccaggctgacgatgagctcactattattgcagctcatatacaagcagcatcacttgggtgttcggcggagggaccgactggaccgtcttaggtcagcccaaggctcgcccctggtcactctcgttcccgcctcctcactctacactactcgngcggcg

SEQ ID NO: 61511 - DNA, 626 bp, Homo sapiens
  misc_feature: GYAE6OF02JMCO6.37.14.B03.1.454.CMB.1.raw
  modified_base (264)..(265): a, c, t, g, unknown or other
  misc_feature (264)..(265): n is a, c, g, or t
  modified_base (568)..(573): a, c, t, g, unknown or other
  misc_feature (568)..(573): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacgagggtccgtcgggcccgacgtctcgccctcgactcacgcctcgcctccgtgtcgtggtctcctggacagtcgactcaccactctcctcgcacgtacggaacccgacgagtgtacgtggttaggttaanntaacttaagttacgttacgttacgttacggttaaccgtaactaactaccaacccgaacggaaccgaaaccgtaacccctaaacctacctaacgtacgtaagtttagtaggtaacggaacgtaacggtaacggaccggtaccgtacggtacgggtttacgttaacgttacgtacgttacgttacgtacggtaccgtaccgtaacgtacgtacggtacgaacgaccggtaccgtacccgtacgtactaactactacgtacggtacgtaccgtacgtacgtacgacggacggacggtacgtacgtnnnnnngtacttacgtacgttacgtacgtacgtacgtactacgtacgtacgtacgtacg

SEQ ID NO: 61512 - DNA, 501 bp, Homo sapiens
  misc_feature: GYAE6OF02G1BYS.37.14.B03.1.454.CMB.1.raw
tcagtagtgtagatcacgaccggtgctcgatttagtgtgagtagttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggcctcagggtctctaatcgcttctctggctccaagtctggcaacacgcctcctgaccatctctgggctccaggctgacgacgaggctcactattattgcagctcatatacaagcagcatcacttgggtgttcggcggagggaccgactgaccgtcttacggtcagcccaaggcctcgcccctggtacc

SEQ ID NO: 61513 - DNA, 517 bp, Homo sapiens
  misc_feature: GYAE6OF02H8SBB.37.14.B03.1.454.CMB.1.raw
tcagtagtgtagatcacgaccggtgctcgatttagtgtgagtagttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgagtcactaaacggccctcaggggtctctaatcgcttctctggctccaagtctggcaacacgctccctgaccatctctgggctccaggctgacgacgaggctcactattattgcagctcatatacaagcagcatcacttgggtgttcggcggacgggaccgaccgtgaccgtcgtttaacggtcacgcccgaaaggcctggccccccctggtacccg

SEQ ID NO: 61514 - DNA, 522 bp, Homo sapiens
  misc_feature: GYAE6OF02IEO1X.37.14.B03.1.454.CMB.1.raw
  modified_base (463)..(463): a, c, t, g, unknown or other
  misc_feature (463)..(463): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtcccaaactcatgatttatgaggtcactaaacggccctcaggggtctctaatcgcttctctggctccaagtctggcaacacggcctccttgaccatctctgggctccagactgaggacgaggctgattattactgcagttcatatagaggcgacacacttatgtcttcggaagtgggaccaagggtcgtcgtcctaagtcagcccaaggcccaaacccntgtccactctcgttcccgcctcctcatcctacactactgacgtcgggctgggctaacgg

SEQ ID NO: 61515 - DNA, 514 bp, Homo sapiens
  misc_feature: GYAE6OF02HA0I8.37.14.B03.1.454.CMB.1.raw
tcagtagtgtagatcacgaccggtgctcgatttagtgtgagtagttccgcgggggggtctcaggaggcagcgctctcaggacatctccaccatggcctgggctctgctgctcctcaccctcctcactcagggaacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcaggggtctctaatcgcttctctggctcaagtctggcaacacggcctccctgaccatctctgggctccaggctgacgacgaggctcactattattgcagctcatatacaagcagcatcacttggtgttcggcggagggaccgaccgtggaccgttcttaggtcagcccgaggcctcggccccctggtcctaccg

SEQ ID NO: 61516 - DNA, 519 bp, Homo sapiens
  misc_feature: GYAE6OF02H8LUC.37.14.B03.1.454.CMB.1.raw
  modified_base (397)..(397): a, c, t, g, unknown or other
  misc_feature (397)..(397): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
tcagtagtgtagatcacgaccggtgctcgatttagtgtgagtagttccggggactttgcctgggctctgctgctcctcacctcctcactcagggcacagggtcctgggcccagtctgccctgactcagcctgcctccgtgtctgggtctcctggacagtcgatcaccatctcctgcactggaccagcagtgatattgaaacttataaccttgtctcttggtaccaacagcaccaggcaaagcccccaaatcatgatttgtgaggacagtaagcggcctcaggggtttctaatcgcttctctggctccaagtctggcaacacggcctccctgacaatctctgggctccaacctgaggacgaggctcactattattgcagctcatatacaagcagcgtnacgttgggtgttcgggcggacgggaccgacgtgaccgttcttaggtcacgcccgaaggcctcgccccgtcggtcactctcgttcccncctcctcacttctacnctactgacgcggctggacg

SEQ ID NO: 61517 - DNA, 523 bp, Homo sapiens
  misc_feature: GYAE6OF02GASPX.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcaggggtctctaatcgcttctctggctccaagtctggcaacacggcctcctgaccatctctgggctccaggctgacgacgaggctcactattattgcagctcatatacaagcagcatcacttgggtgttcggcggacgggaccgacctgaccgtcttaggtcacggcccaaggctcgcccccgtcggtccactctcgttcccaccctcctccactcctacactactgacgcgggctcggg

SEQ ID NO: 61518 - DNA, 507 bp, Homo sapiens
  misc_feature: GYAE6OF02JFQYV.37.14.B03.1.454.CMB.1.raw
  modified_base (484)..(484): a, c, t, g, unknown or other
  misc_feature (484)..(484): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactcatgatttatgaggtcactaaacggccctcaggggtctctaatcgcttctctggctccaagtctggcaacacggcctcctgaccatctctgggctccaggctgacgacgaggctcactattattgcagctcatatacaagcagcatcacttgggtgttcggcggagggaccgactgaccgtcttaggtcagcccaaggctgcccctcggtcactctcgttcccacctccncatctacactactcgagcggtcg

SEQ ID NO: 61519 - DNA, 514 bp, Homo sapiens
  misc_feature: GYAE6OF02FWL7Z.37.14.B03.1.454.CMB.1.raw
tcagtagtgtagatcacgaccggtgctcgatttagtgtgagtagttccgcggggggtcgtcaggaggcagcgctctcaggacatctccaccatggacctgggctctgctgcttcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaaactcatgatttatgaggtcactaaaacggccctcaggggtctctaatcgcttctctggctccaagtctggcaacacggcctccctgaccatctctgggctccaggctgacgacgaggctcactattattgcagctcatatacaagcagcatcacttgggtgttcggcggaggaccgacctgaccgtcgttacggtcacgcccaaggcctacgcccctggtacc

SEQ ID NO: 61520 - DNA, 584 bp, Homo sapiens
  misc_feature: GYAE6OF02G85LW.37.14.B03.1.454.CMB.1.raw
  modified_base (531)..(532): a, c, t, g, unknown or other
  misc_feature (531)..(532): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (570)..(570): a, c, t, g, unknown or other
  misc_feature (570)..(570): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
tcagtagtgtagatcacgaccggtgctcgatttagtgtgagtagtttagggggtttggggcgtttgtctgggtcctcctggacgagtcgatcaccagtcccctgcacgtccggaaccagtagtgaccgttggatcgattatgactatgtctccctggtttcacaacaccagacaaacgccccaactcatcacttttgagtctactaactcggcctcagaatttcttctcggcttctctgccctccaagttcctggtcaaccgaccggccttccttagacctattcctcgtcgggtcgtccgacgtacgtgacggacgaggactacgaagttaacttacctagtccagttcattagtaggacggtctaaccttacaacgtttagtcgttcttacgggtagtgggaccgaaggtcgtcgtccttaagtcgacgaccgaagtcccaaacccctctcgtaccaacttcctacgttcccccacccgttccctcactcctacactacttgacgtcgggctaggctacgcgacaatgnngnngntcncnctcgcnggcngntcgatatacgcagtgngctcncnctctctc

SEQ ID NO: 61521 - DNA, 520 bp, Homo sapiens
  misc_feature: GYAE6OF02GTZO3.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcatcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaaacggccctcaggggtctctaatcgcttctctggctccaagtctggcaacacggcctccctgaccatctctgggctccaggctgacgacgaggctcactattattgcagctcatatacaagcagcatcacttgggtgttcgggcgggagggaccgaccgtgaccgtcttaggtcagcccaaggctcgcccctcggtccactctcgttcccgccctcctcactctacactactgacgcggctacgg

SEQ ID NO: 61522 - DNA, 522 bp, Homo sapiens
  misc_feature: GYAE6OF02F56KS.37.14.B03.1.454.CMB.1.raw
  modified_base (226)..(226): a, c, t, g, unknown or other
  misc_feature (226)..(226): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccncagtgacgttggtggttataactatgtctcttggtaccaacatcacccaggcaaagtccccaaactcatgatttatgaggtcactaaacggcctcgagggtctctaatcgcttctctggctccaagtctagcaacacggcctccctgaccatctctggctccaggctgacgacgaggctcactattattgcagctcatatacaagcagcatcacgttgggtcgttcggcggtacgggaccgtaccgtgtaccggtcttaggtcgacgcccgtaaggcctcggcccccgtggtaccc

SEQ ID NO: 61523 - DNA, 528 bp, Homo sapiens
  misc_feature: GYAE6OF02HSXKX.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaaactcatgatttatgaggtcactaaaacggccctcaggggtctctaatcgcttctctggctccaagtctggcaacacggcctccctgaccatctctgggctccaggctgacgacgaggctcactattattgcagctcatatacaagcagcatcacgttgggtgttcgggcggagggaccgaccgtgaccgtcgttacggtcacgcccaaggctacgcccctcggtccactctcgttcccgccctcctccactcctacactactgacgtcgggctcgg

SEQ ID NO: 61524 - DNA, 521 bp, Homo sapiens
  misc_feature: GYAE6OF02IOF84.37.14.B03.1.454.CMB.1.raw
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccccgcagtgacgttggtggttataactatgtctcttggtaccaacatcacccaggcaaagtccccaaactcatgatttatgaggtcaactaaacggccctcagggtctctaatcgcttctctggctccaagtctggcaacacggcctcctgaccatctctcgggctccaggctgacgacgaggctcacttattattgcagctcatatacagcagcatcacttgggtgttcggcggacgggaccgacctcggaccgttcttaggtcacggcccgaaggcctcggtccccctggtaccc

SEQ ID NO: 61525 - DNA, 510 bp, Homo sapiens
  misc_feature: GYAE6OF02FM480.37.14.B03.1.454.CMB.1.raw
  modified_base (310)..(310): a, c, t, g, unknown or other
  misc_feature (310)..(310): n is a, c, g, or t
  modified_base (482)..(482): a, c, t, g, unknown or other
  misc_feature (482)..(482): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataatttangagtcactaaacggccctcaggatttcaatcgcttctctggctccaagtctggcaacacggcctccctgaccatctctgggctccaacctgaggacgaggctcactattattgcagctacatatacaagcagcgtcacttgggtgttcggcggagggaccgacctgaccgtnttacggtcagcccaaggcctgtcccccg

SEQ ID NO: 61526 - DNA, 516 bp, Homo sapiens
  misc_feature: GYAE6OF02FM3FT.37.14.B03.1.454.CMB.1.raw
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgcttctctggctccaagtctggcaacacggcctccctgaccatctctgggctccaggctgacgacgaggctcactattatgcagctcatatacaagcagcatcacttgggtgttcgggcggagggaccgaccgtgaccgtcttaggtcacgccaaggctcgccccgtcgtcactctcgttcccgccctcctcactcctacactacngacggcggntcgg

SEQ ID NO: 61527 - DNA, 545 bp, Homo sapiens
  misc_feature: GYAE6OF02HGNBE.37.14.B03.1.454.CMB.1.raw
  modified_base (362)..(362): a, c, t, g, unknown or other
  misc_feature (362)..(362): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaatcatgatttgtgaggacagtaagcggccctcgaggggtttctaatcgtcttctctgctcaagtctgcaacncgcctcctgacatctctggctccgagctgacggacgaggctgtatttattactgtctgctctatatgctaggtatcacttcttagtgttccgttacggaacgttacgggaaccctaaggttccaacccggttacctaacgttccgaacggaccccgaacgggacccctaaccccacgttaccg

SEQ ID NO: 61528 - DNA, 543 bp, Homo sapiens
  misc_feature: GYAE6OF02G5G1L.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgcttctctggctccaagtctggcaacacggcctcctgaccatctctgggctcaggctgacgacgagctcactattattgcagctcatatacaagcagcatcacgttgggtgttcgggcgggagggaccgtaccgtcgaccgtcgttacggctacgcccgaaggcctcgcccccttcgggtcctaccgtccttcggttccccgtccctcctccgtactcctacaccttactggacgcggcgtacggg

SEQ ID NO: 61529 - DNA, 527 bp, Homo sapiens
  misc_feature: GYAE6OF02I9A5M.37.14.B03.1.454.CMB.1.raw
  modified_base (523)..(523): a, c, t, g, unknown or other
  misc_feature (523)..(523): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcaggggtctctaatcgcttctctggctccaagtctggcaacacggcctccctgaccatctctgggctccaggctgacgacgaggctcactattattgcagctcatatacaagcagcatctacttgggtgttcgggcggagggaccgaccgtgaccgtcgttacggtcacgcccaaggctcgcccctcggtccactctcgttccccacccttcctctactcctacactacgtgacgcgggntcgg

SEQ ID NO: 61530 - DNA, 565 bp, Homo sapiens
  misc_feature: GYAE6OF02HU8P6.37.14.B03.1.454.CMB.1.raw
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaanatcacccaggcaaagtccccaaactcatgatttatgaggtcactaaacggcctnaggcgtctctaatcgcttctctggctccaagtctggcaacacggcctccctgaccatctctgggctcaggctgacgacgaggctacactattattgcagctcatatacaagcagcatctacgtttgggtgttcgggcgggagggacccgacgtcgaccgttcgttacggtcacgcccgaaggcctaccgcccccgtcgggtacctaccgttccgtccggttcccccgccccttccctacctacttccttaccaccttaccgtaggaccggtccgggtaccgg

SEQ ID NO: 61531 - DNA, 534 bp, Homo sapiens
  misc_feature: GYAE6OF02GQ5ZZ.37.14.B03.1.454.CMB.1.raw
  modified_base (228)..(228): a, c, t, g, unknown or other
  misc_feature (228)..(228): n is a, c, g, or t
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactcggaacccncaggtgacgttggtgttaataaatatgtctcttggtaccaacatcaccaacatccacccaggcaaagtccccaaatcaataatttangagtcactaaacggcctnaggtatttactaatcgcttctctggctcaagtctgcaacncggcctccngaccatcnctggctccactgagacgagctcacttattatgcagctcatatacaagcagccgtcacgttgggtcgttcggacgggtacgggaccgtaccgtcgtacccgttcgttacggtcgacggacccgtaaggccgtccgccccgttcgg

SEQ ID NO: 61532 - DNA, 625 bp, Homo sapiens
  misc_feature: GYAE6OF02FGK3J.37.14.B03.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagtagtgtagatcacgaccggtgctcgatttagtgtgagtagttccgcgggggggggtctcaggaggcagcgctctcaggacagtctccaccatggcctgggctcctgctgcctcctcacccttcctcactcagggcacagggtcctcgggcccagtctgccctgactcagcctgcctccgtgtctgggtcctccgtggacngtcgatcaccatcctctgcactggaacccgnagtagacgtttggtggtttataacttatgtctgttaggtaccaaacgactcaccccaggccaaaggtccccaaactcatgatttactgacggtacaactaaaccggcccgtactacggtagtttactaatccgtcttctctcggctaccaagtctcgggacaaacgacgggcccttacccgtcggaaccctatccgtcgttcggggccctaccgaacccgtggaacggtacgaaggcctacacttaatttattgtacacgctactaatattacaagtccagtcgtacgtacgttggtcggtacggcgggtaaggaccgacgtcggtaccggtcgttacgggcccaggtcccgaaggtcccgtacgtcccccgtcggtcctaccgttcccg

SEQ ID NO: 61533 - DNA, 540 bp, Homo sapiens
  misc_feature: GYAE6OF02GIKV1.37.14.B03.1.454.CMB.1.raw
  modified_base (264)..(264): a, c, t, g, unknown or other
  misc_feature (264)..(264): n is a, c, g, or t
tcagtagtgtagatcacgaccggtgctcgatttagtgtgagtagttccggggacgtttgcctgggctctgctgctcctcaccctcctcactcagggcacagggtcctgggcccagtctgccctgactcagcctgcctccgtgtcctgggtctcctggacagtcgatcaccatctcctgcactggaacccgcagtgacgttggtggttataactatgtctcttggtaccaacatcaccaggcaaagtccccaaatcatgatttangaggtccacgtaaacggccctgaggggtctctaatcgcttctctggctccaagtctggcaacacggcctcctgaccatctctgggctccaggctgacgacgaggctacactattacttgcagctcatatacaagcagcatccacgtttggtgttcggcgggacgggaccgaccgtcggaccgttcttagggtccacggtcccgaaggtcctacggtcccctggtccacgtcctcggtccccgccttccgtcactctacactactgacgcggctcgg

SEQ ID NO: 61534 - DNA, 514 bp, Homo sapiens
  misc_feature: GYAE6OF02FSLBW.37.14.B03.1.454.CMB.1.raw
  modified_base (419)..(419): a, c, t, g, unknown or other
  misc_feature (419)..(419): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggcctcagggtctctaatcgcttctctgctcaagtctggcaacacggcctccctgaccatctctggctccaggctgacgacgaggctcactatattgcagctnatatacaagcagcatcacgttgggtgttcggcggagggaccggacctcggaccgttcgttaggtcgacgccaaggcctcggccccgtcggtcccg

SEQ ID NO: 61535 - DNA, 555 bp, Homo sapiens
  misc_feature: GYAE6OF02GD8NL.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacgtttgggtgttcgggcggacgggaccgaccgtgacccgttcgttacggtcacgcccgaaaggcctaccgcccccgttcggtccaccgttcgtcgttcccccacccttcctcacgttcctaccaccttactcggaggtccggg

SEQ ID NO: 61536 - DNA, 525 bp, Homo sapiens
  misc_feature: GYAE6OF02HXD5I.37.14.B03.1.454.CMB.1.raw
  modified_base (229)..(229): a, c, t, g, unknown or other
  misc_feature (229)..(229): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaanatcacccaggccaaagtccccaaaactcatgatttatgaggtcactaaacggccctcaggggtctctaatcgcttctctggctccaagtctggcaacacggcctcctgaccatctctgggctccaggctgacgacgaggctcactattattgcagctcatatacaagcagcatcattgggtgttcggcggacgggccgacctggaccgttacgttaggtcacgcccaaggtctacgcccctcggtcacttctcggtccctccctcctcactctacactactgacggcggcgtacgg

SEQ ID NO: 61537 - DNA, 596 bp, Homo sapiens
  misc_feature: GYAE6OF02HGCTP.37.14.B03.1.454.CMB.1.raw
  modified_base (389)..(389): a, c, t, g, unknown or other
  misc_feature (389)..(389): n is a, c, g, or t
  modified_base (440)..(440): a, c, t, g, unknown or other
  misc_feature (440)..(440): n is a, c, g, or t
tcagtagtgtagatcacgaccggtgctcgatttagtgtgagtagttccggggactttgcctggggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgagtcactaaacggcctcgaggggtctctaatcgcttctctggctccaagtctggccaacacggcctccctgaccatctcgtgggctcgaggctagacgacgaggctcactattattgcagtctntaatactacaagcagctatctacgttgggtcgttcgggacggacgggaccnccgtcgaccgttcgttacggtcacgaccgaaggtcctcggcccccgttggtacccaccgttccgttccgtttaccccctaccccgttccgttaccgtaccgttacctaacccgttaccgtaccgttacggacgggtcccgggtaccgtaaccgggg

SEQ ID NO: 61538 - DNA, 510 bp, Homo sapiens
  misc_feature: GYAE6OF02HPZSY.37.14.B03.1.454.CMB.1.raw
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtcccaaactcatgatttatgaggtcactaaacggcctcagggtttctaatcgcttctctgctccaagtctggcaacacggcctcctgacaatctctggctccaggctgaggacgaggctgattatactgctgctcatatgcaggtagtcacttcttatgttcttcggaactgggacaaggtcaccgtctaagtcagcccaaggccaacccgactcgtcactctcgttcccgccctcctcactctacnctacngagcggtctggacg

SEQ ID NO: 61539 - DNA, 536 bp, Homo sapiens
  misc_feature: GYAE6OF02HF274.37.14.B03.1.454.CMB.1.raw
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttggtaccaacatcacccaggcaaacgtccccaaactcatgatttatgaggtcaactaaacggccctcagggtctctaatcgcttctctggctcaagtctggcaacncggcctcctgaccatctcgtggctccgaggctgacgacgaggctcacttattattcncngctctatatacagcagcatctacgttgggttcgtcgggcgggtacgggaccgtaccgtcgtaccgttcgttacggtcgacggcccgaacggtccgtccgtcccccgtggtcccg

SEQ ID NO: 61540 - DNA, 511 bp, Homo sapiens
  misc_feature: GYAE6OF02FNJ9L.37.14.B03.1.454.CMB.1.raw
  modified_base (507)..(507): a, c, t, g, unknown or other
  misc_feature (507)..(507): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgcttctctggctccaagtctggcaacacggcctcctgaccatctctgggctccaggctgacgacgaggctcactattattgcagctcatatacaagcagcatcattgggtgttcggcggagggaccgaccgtgaccgttgttacggtcacgcccaagctcgccctcgtcactctcgtcccacctcctcactctacactacgtgacgcggntcgg

SEQ ID NO: 61541 - DNA, 526 bp, Homo sapiens
  misc_feature: GYAE6OF02GNT92.37.14.B03.1.454.CMB.1.raw
  modified_base (189)..(189): a, c, t, g, unknown or other
  misc_feature (189)..(189): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtctcttggtaccaacatcacccaggcaaagtccccaaactcatgatttatgaggtcactaaaacggccctcaggggtctctaatcgcttctctggctccaagtctggcaacacggcctccctgaccatctctgggctccaggctgacgacgaggctcactattattgcagctcatatacaagcagcatcagtttgggtttcggcggagggaccgacgtgaccgttcttaggtcacgcccgaaggctcgcccctggtccacgtcctcgttccccaccctcctcactcctacactacgtgcggcggctggaccg

SEQ ID NO: 61542 - DNA, 514 bp, Homo sapiens
  misc_feature: GYAE6OF02GESXI.37.14.B03.1.454.CMB.1.raw
  modified_base (227)..(227): a, c, t, g, unknown or other
  misc_feature (227)..(227): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtgttataactatgtctcttggtaccaacatcacccaggcaaagtccccaaaactcatgatttatgaggtcactaaacggccctcaggggtctctaatcgcttctctggctccaagtctggcaacacggcctccctgaccatctctggctccaggctgacgacgaggctcactattattgcagctcatatacaagcagcatcacgttgggtgttcggcggacgggaccgactggaccgtcgttaggtcacgcccgaaggctcgcccccgtggtaccc

SEQ ID NO: 61543 - DNA, 558 bp, Homo sapiens
  misc_feature: GYAE6OF02H7144.37.14.B03.1.454.CMB.1.raw
tcagtagtgtagatcacgaccggtgctcgatttagtgtgagtagttccgcgggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcaccatctcctgcactcggaaccgcagtgtacgttggtggttaataactatgtctcttggtacacatcaccaggcaaagtccccaaatcatgattatgaggtcactaaacggtcctagagggtctactaatcgtcttctctgctacagtctgacacgaccggcctccctcgaccactctcgtcggcctccgacgctgacgacgcggctagacttattagttgcagtctcgtaatataactaacgtacacgtacagtctacgttagggtgttccgggacgggtaacgggtaccgtaccgtacgtaccggtcgttacggtcgtacgacccgaggtccgtcggtacccccgtgtacccg

SEQ ID NO: 61544 - DNA, 597 bp, Homo sapiens
  misc_feature: GYAE6OF02F8DGF.37.14.B03.1.454.CMB.1.raw
  modified_base (372)..(372): a, c, t, g, unknown or other
  misc_feature (372)..(372): n is a, c, g, or t
  modified_base (389)..(389): a, c, t, g, unknown or other
  misc_feature (389)..(389): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctttgcctccgtgtctgggtctcctggacagtcgatcaccatctcctgcactggaacccgcagtgacgttggtggttataactatgtctcttggtaccaacatccaccaggacaaacgtccccaaactcatgatttatgagtcactaaacggcctcaggggtctctaatcgcttctctggctccaagtctggcaacacggcctcctgaccatctctcgggctccaggctgacgacgaggctnacttattattgcagctnatatacagcagcatcacgttgggtcgttcgggcggacggggtacccacgtcgtaccgttcgttacggtcacggcccaacggtcctccggtcccccttacgggtccctaccgttccgttccggttacccccctaccccgttccctaccctaccgttaccttaaccctaccgttaacccgtcgggtaccgggtccgggtaccctacgggg

SEQ ID NO: 61545 - DNA, 526 bp, Homo sapiens
  misc_feature: GYAE6OF02G2WTA.37.14.B03.1.454.CMB.1.raw
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (425)..(425): a, c, t, g, unknown or other
  misc_feature (425)..(425): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcaccaggcaaacgccccaaatcatgattgtgagacagtaagcgcctgagggtttctaatcgcttcnctggctacaagtcnggacaacacgcctccctgaccatctcgtcggctaccaacgtgaggacgaggcctcaacttaattactgcagtctnaatatacaagcagcaagtctagttgggtcgttcggcggaggaccgaccgtcgaccgttcgtacggtcacgcccgtaaggcccgtcgtccccgtcgtacccg

SEQ ID NO: 61546 - DNA, 518 bp, Homo sapiens
  misc_feature: GYAE6OF02I4AQ9.37.14.B03.1.454.CMB.1.raw
  modified_base (424)..(424): a, c, t, g, unknown or other
  misc_feature (424)..(424): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcaggggtctctaatcgcttctctggctccaagtctgcaacacggcctccctgaccatctctgggctccgagctgacgacgaggctcactattattgcagctnatatacaagcagcatcacgttgggtgttcggcgggacggaccgcctgaccgttcttaggtcacgacccgaaggccgtcgcccccgtcggtaccc

SEQ ID NO: 61547 - DNA, 590 bp, Homo sapiens
  misc_feature: GYAE6OF02G3G4A.37.14.B03.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactcggaacccgnagtgacgttggtgttataactatgtctcttcggtaccaacactccacccaggacaaacgtccccaaactcatgtatttangaggtcaactaacgccctcgagggtctactaatcgcttctntcggctccaagtctgacaacgacgccctcccngacctatcctcgtcgggcctccgaggtcgtcggaacggacgaggtcctctaacttaatttagttcgcagtctactaagtactaacaagccaagcctattcgtaggttcgggtaggtcgggacgggacgggtacccgtaccggtcgtaccggttcgttacggtacgaccggaacccgtacggtcccgtcccgtaccccggttcgtaccc

SEQ ID NO: 61548 - DNA, 705 bp, Homo sapiens
  misc_feature: GYAE6OF02JXCGM.37.14.B03.1.454.CMB.1.raw
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
tcagtagtgtagatcacgaccggtgctcgatttagtgtgagtagttccgcggggggggtctcgaggaggcagcgctctcaggacatctccaccatggcctgggctctgctgctcctcaccctcctcactcagggcacacgggtcctgggcccagtctgccctgactcagcctgcctcgtgtcgtgggtctcctggacaggtcgatcaccntcctcctgcactcggaacccnagtgacggttgngttaataactatgtctctggtaccactatcaccaggctaaacgtccccaaactcacgtgtattatagaggtacaacgtaaacggtccctacgtaacgggtctacgtaaatcgtaccttctcgtcgtcctaccaacgttcgtacggactaaccgacggtcccttacccgtgtaaccctacttaccgtacgtcggtacccgtccgtacggtacgtacgaaccggtacggacggtacctacgtacgttaacgtttactacgacctagtacctaccgaagtttaacgtaacctaagacgtacggcctaaactacggttaccggttgggttaacgttccgggacgggttaacgggtaacccggttaccgttaccggttaccggttaccggtttaccgggtaccgttaaccgggtacccggtaaccggggcccgtttaccccggaccccggttacccgggttaccccg

SEQ ID NO: 61549 - DNA, 510 bp, Homo sapiens
  misc_feature: GYAE6OF02GWYV1.37.14.B03.1.454.CMB.1.raw
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcaccaggcaaagccccaaatcatgattgtgagacagtaagcggcctcgaggggtttctaatcgcttctctggctcaagtctggcaacacggcctcctgaccatctctgggctcaggctgacgacgacggctacactattatgcagctcatactacagcagcatcagttgggtcgttcggacggagggcccgacttcggaccgttcttacggtcacggccctaaggctaccggcccctacgg

SEQ ID NO: 61550 - DNA, 549 bp, Homo sapiens
  misc_feature: GYAE6OF02HZ4E2.37.14.B03.1.454.CMB.1.raw
  modified_base (273)..(273): a, c, t, g, unknown or other
  misc_feature (273)..(273): n is a, c, g, or t
  modified_base (514)..(514): a, c, t, g, unknown or other
  misc_feature (514)..(514): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttangaggtcactaaacggcctcaggggtctctaatcgcttctctggctccaagttctggcaacaccggcctccctgacccatctctgggctccaggctgacgacgaggcctcactattatttgcagctcattactacaagcagacatctacgttgggtgttccgggcggaaggggaccgaccgtgaccgtcttacggtcacgccgaaggcctcgccccctcggtctaccttctccgttaccccncccttccctcctactaccctacctaccgtactcgg

SEQ ID NO: 61551 - DNA, 564 bp, Homo sapiens
  misc_feature: GYAE6OF02IPYQZ.37.14.B03.1.454.CMB.1.raw
  modified_base (245)..(245): a, c, t, g, unknown or other
  misc_feature (245)..(245): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctcctgcactcggaacccgcagtgacgttggtgttanaactatgtctcttggtaccaacatcacccaggcaaagtccccaaactcatgatttatgaggtcactaaacgccctcagggtctactaatcgtcttctctggctcaagtctggctaacgacgcctcctcgaccatctctcggctcgagctgacgacgagctacacgttacttattcgcagtctacaatactacaagacacgtacactcgtacgttgggtacgttcggacgggacggtacccgtacgttcggtacccgttacgttacggtacctaccggacccgtaaacggtcccgtaccggtcccccgttcggtaacccg

SEQ ID NO: 61552 - DNA, 553 bp, Homo sapiens
  misc_feature: GYAE6OF02F7JWM.37.14.B03.1.454.CMB.1.raw
  modified_base (189)..(189): a, c, t, g, unknown or other
  misc_feature (189)..(189): n is a, c, g, or t
  modified_base (500)..(500): a, c, t, g, unknown or other
  misc_feature (500)..(500): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttataactatgtcttcttggtaccaacatcacccaggcaaacgtccccaaatcatgtatttatgaggtcacctaaacggcccctacgaggggtctctaatcgtcttctctggcctccaagtctggcaacacgcctcctgaccatctcgtgggctccgagctgacgacgacgctacactattatgcagctcatatacaagcagcatctacgttgggtcgttcgggcgggacgggaccgtaccgtcgtaccggtacgttacggtaccacgacccgtacgccgtccgtccccgtcgtccncgttcctcgttccccacctcctctctactactactcgagtacggcgcgtacgg

SEQ ID NO: 61553 - DNA, 528 bp, Homo sapiens
  misc_feature: GYAE6OF02H5A0P.37.14.B03.1.454.CMB.1.raw
  modified_base (418)..(418): a, c, t, g, unknown or other
  misc_feature (418)..(418): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtgttataactatgtctcttggtaccaacatcacccaggcaaagtccccaaaactcatgatttatgaggtcactaaacggccctcaggggtctctaatcgcttctactgctccaagtctgcacacgcctccctgaccatctctggctccaacctgacgacgagctacactattattgcanctcaatataacaagcagcgtcacgtttgggtgttcggcgggaggaccgaccgtggtccgtacgttaggtcacgcccgtaaggcctcggtccccctcggtccacgttcccg

SEQ ID NO: 61554 - DNA, 630 bp, Homo sapiens
  misc_feature: GYAE6OF02IE3IA.37.14.B03.1.454.CMB.1.raw
  modified_base (228)..(228): a, c, t, g, unknown or other
  misc_feature (228)..(228): n is a, c, g, or t
  modified_base (398)..(398): a, c, t, g, unknown or other
  misc_feature (398)..(398): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttgtaccaanagccaccaggacaaacgccccccaaatcatgtatttgtgaggacagaagcgcctacgtagggtttactaatcgtcttctcgtggctcaagtctgacaacgaccggcctcctagactaatcctcgtcggcctcgagtcgtaggaggacggagtctagtatttagtttacgngtctgtactctaatatgacgtagggtactctaactttcttaagttcgttacgttaccgggaacgtacgggaaccgtaacgggtacctaccgtacctaacggtccaaccgacccgtaaccgacccaaccctattaccgacctaccgttccgttaccgttaccccctacccttaccctaccgtaaccttacctaacccgtaccttaacccggtggtaccgggtccggtaaccgg

SEQ ID NO: 61555 - DNA, 521 bp, Homo sapiens
  misc_feature: GYAE6OF02F1JYQ.37.14.B03.1.454.CMB.1.raw
  modified_base (516)..(516): a, c, t, g, unknown or other
  misc_feature (516)..(516): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaaatcatgatttatgaggtcactaaacggccctcaggggtctctaatcgcttctctggctccaagtctggcaacacggcctccctgaccatctctgggctccaggctgacgacgaggctcactattattgcagctcatatacaagcagcatcacttgggtgttcgggcggagggaccgaccgtgaccgtcttaggtcagcccaaggctcgcccctcggtcactctcgttccccgcccttcctcactcctacactactgacgcgggntcggg

SEQ ID NO: 61556 - DNA, 662 bp, Homo sapiens
  misc_feature: GYAE6OF02GI5LP.37.14.B03.1.454.CMB.1.raw
  modified_base (228)..(228): a, c, t, g, unknown or other
  misc_feature (228)..(228): n is a, c, g, or t
  modified_base (361)..(361): a, c, t, g, unknown or other
  misc_feature (361)..(361): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactcggaacccnagtgacgttggtgttataactatgtctcttggtaccaacatcacccaggacaaacgtccccaaactcatgatttatgagtcactaaacggcctcagggtctctaatcgcttctctggctccagtctggcaacncgcctccctgaccatctcgtcggcctccgaggctaggaccgacgaggcctacgacttagttatttcgactagcctactaagttaactaacctaacgtacaacggacctaacgttaccgtaacggttttgggggttaccgggtttaccggggaccggggtaaccgggggtaaccccggtaacccggtttaccgggttaaccccgggtttaccggttttaacgggttacccgtaacccgggtaccccggtaaaccggggtccccggttaccccgggtcccccccgttaccgggttaacccccg

SEQ ID NO: 61557 - DNA, 559 bp, Homo sapiens
  misc_feature: GYAE6OF02H3L4U.37.14.B03.1.454.CMB.1.raw
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccccgcagtgacgttggtggttaataaatatgtctcttggaccaanatcaccaacatcacccaggcaaagtccccaaatcataatttangaaggtcaactaaacggccctanaggtattactaatcgctttcnctggctaccaagtctggacaacacggcctccctgaccatctcgtggcctaccaactgacggacgaggcctacgacttattattcgcagtctacataatacaagcagccgtactacgttgggttgttaccgggacggacgggtaacccgtaccgtacggaccgttacgtacggtcacggacccaacggcctccgccccctacgg

SEQ ID NO: 61558 - DNA, 538 bp, Homo sapiens
  misc_feature: GYAE6OF02GCUL5.37.14.B03.1.454.CMB.1.raw
  modified_base (228)..(228): a, c, t, g, unknown or other
  misc_feature (228)..(228): n is a, c, g, or t
  modified_base (447)..(447): a, c, t, g, unknown or other
  misc_feature (447)..(447): n is a, c, g, or t
  modified_base (472)..(472): a, c, t, g, unknown or other
  misc_feature (472)..(472): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtgttataaatatgtctcttggtaccaacatcaccaacatccacccaggacaaacgtccccaaaactcaataatttatgaggtcaactaaacggcctacaggtagtttctaatcgcttctcgtgctacaagtcgtagacaacacggccctcctgaccatctcgtggcctaccgaacctgacggacgaggctcacttattatgcagctanatatacaagcagctacacgttgggngttcggacggacggaccgactcggacccgttgttacggcacgccgaacggctccgccccgtaccgg

SEQ ID NO: 61559 - DNA, 564 bp, Homo sapiens
  misc_feature: GYAE6OF02HMZOW.37.14.B03.1.454.CMB.1.raw
  modified_base (416)..(416): a, c, t, g, unknown or other
  misc_feature (416)..(416): n is a, c, g, or t
  modified_base (489)..(489): a, c, t, g, unknown or other
  misc_feature (489)..(489): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataaatatgtctcttggtaccaacatcaccaacatccacccaggacaaacgtccccaaactcaattaatttatagaggtcaactaaaccggccctcaggtagtttctaatcgtcttctctggtcctcaagttctaggtacaaccaccggcctccctgaccctatctcgtcggtcctaccaactgacgacgagctacactattatgcagctnatatacagcagcgtactacgttggtgttcggcggtacggaccgactcgaccgttgtacgctacgacccaggcnccgtccccgtcgcctactccgtccttccctacccgtcctactacctactactacctacgtacgacggtcggaccg

SEQ ID NO: 61560 - DNA, 516 bp, Homo sapiens
  misc_feature: GYAE6OF02HQVVX.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcactaaacggccctcaggggtctctaatcgcttctctggctccaagtctggcaacacggcctccctgaccatctctgggctccaggctgacgacgagctcactattattgcagctcatatacaagcagcatcattgggtcttcggcggagggacccgaccgtgaccgtcttagggtcacgcccaaggcctcgcccctggtcacgtctcgtcccaccctctcactctacactactgacgtcggctcggg

SEQ ID NO: 61561 - DNA, 610 bp, Homo sapiens
  misc_feature: GYAE6OF02I29VJ.37.14.B03.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtgacngtcgatcaccatctctgcactcggaacccgcagtcgacgttggtgttatactatgtctnttgtaccaacatcacccagacaacgtccccaaactcatgtattatgagtcacgtaaacgcctcgagggtctactatcgcttctctggcctcaacgttctggcaaacgacgccctcctacgacctatccttcgtcggcctccgaggtctaggaccgtacggacggtcctaccgtaacttagttttacgtcgtccgaacgtcctaccgtaattaacctaacgaacgacgtacgactacgttaccgtacggtttcggggtcgttacggggcgggtaacggacccggtctaccggtaccggttccgttacggaccgtacggaccctaacgggtccctacggtcccccgtcgttaacccg

SEQ ID NO: 61562 - DNA, 552 bp, Homo sapiens
  misc_feature: GYAE6OF02F1P0Y.37.14.B03.1.454.CMB.1.raw
  modified_base (227)..(227): a, c, t, g, unknown or other
  misc_feature (227)..(227): n is a, c, g, or t
  modified_base (382)..(382): a, c, t, g, unknown or other
  misc_feature (382)..(382): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtgttaataactatgtctcttggtaccaacatcacccaggcaaacgtccccaaactcatgatttatgagtcaactaaaccgccctcgacgggtctactaatcgcttctctggctcaagtctggcaacacggcctccctcgacctntctctgggctccgaggctgacgacgaggctcactatttattgcagctacatataacagcagctatctacgtttgggtcgttccgggacggtacgggacccgtaccgtcggtacccgtagtttacggccgacgacccggaaaggccgtaccggtcccccgtcggttacccg

SEQ ID NO: 61563 - DNA, 528 bp, Homo sapiens
  misc_feature: GYAE6OF02FGK2V.37.14.B03.1.454.CMB.1.raw
  modified_base (230)..(230): a, c, t, g, unknown or other
  misc_feature (230)..(230): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (516)..(516): a, c, t, g, unknown or other
  misc_feature (516)..(516): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccccgnagtgacgttggtggttataactatgtctcttggtaccaacatcacccaggcaaacgtccccaaactcatgatttatgaggtcaacgtaaaccggccctcaggggtttctaatcgcttctctggctcagtatgacacacggcctcctgacaatcnctggctccaggctgacggacgnggctagattattctgtctgcttcattatgactggtatcacttctattgtcttcggactgggaaccacggttcaccgttacctagtccacgacccgacggacccaaccccnctcgtctacccg

SEQ ID NO: 61564 - DNA, 582 bp, Homo sapiens
  misc_feature: GYAE6OF02G4D1A.37.14.B03.1.454.CMB.1.raw
  modified_base (229)..(229): a, c, t, g, unknown or other
  misc_feature (229)..(229): n is a, c, g, or t
tcagtagtgtagatcacgaccggtgctcgatttagtgtgagtagttccggcggggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactcggaacccncagtgacgttggtgttataactatgtctcttggtaccaacatcaccaggacaaacgtacccaactcatgtattatgagtcaactaacgcctcgagggtctctatcgcttctctcgtctcagtctcgacacacgtcctcctcgaccacgtctcgtcgggtcctccgacggctcgacggacgacggtctactacttatttacgttcgacgtagtcctagtaacttaactacgaagcaagactattcgtacgttgggttcggttccgggtacgggacgggtacccgtaccgtacggtaccggttagttaccggtcaccggccgtaaccggtcctcccggtccccgttccggtcccg

SEQ ID NO: 61565 - DNA, 517 bp, Homo sapiens
  misc_feature: GYAE6OF02IMBGN.37.14.B03.1.454.CMB.1.raw
  modified_base (227)..(227): a, c, t, g, unknown or other
  misc_feature (227)..(227): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccncagtgacgttggtgttataactatgtctcttggtaccaacatcacccaggcaaagtccccaaactcatgatttatgaggtcactaaacggccctcagggtctctaatcgcttctctggctccaagtctgacacacgcctcctgaccatctcgtcggctccaggctgacgacgaggctcacttattattcgcagctacatactaacagcagcatctacgttgggtgttcggcgggacggccgactcgaccgttcgttacgtcgacgccgaagcgtccgccccgtgtacccg

SEQ ID NO: 61566 - DNA, 588 bp, Homo sapiens
  misc_feature: GYAE6OF02JK2T0.37.14.B03.1.454.CMB.1.raw
  modified_base (317)..(317): a, c, t, g, unknown or other
  misc_feature (317)..(317): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtcccccaaatcatgatttatgagtcactaaacggccctcaggggtctctaatcgcttctctggctccaagtcngcaacaccggcctccctgaccatctcgtgggcctccaggctgacgacggagctcactattattgcagtctcatatacaagcagcatctactttgggtcgttcgggcggtagggacccgcgtacgaccgttacgttacggtcaacgtacccgaaggcccgtacgcccccgttacggtcctaccgttccgtaccggtttcccccgacccttccctcccgaacgttttcccaaccctacgttacccgtggaccgggcgggtacccgttacgggg

SEQ ID NO: 61567 - DNA, 776 bp, Homo sapiens
  misc_feature: GYAE6OF02F4CSW.37.14.B03.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (355)..(355): a, c, t, g, unknown or other
  misc_feature (355)..(355): n is a, c, g, or t
tcagtagtgtagatcacgaccggtgctcgatttagtgtgagtagttccgcggggggggtctctaggggaggacagcgctctcgacggacagtacctccaccgaatccggcctggggcctcgtgtccttgtccttcccttcaccccttccttcacgtcacgggcacacgggtcctggggcccaagtctgacctgactcagcctgcctccgtgtctgggtctccgtggacaggtacgatccacctatccttcgngcacctggaaccccngagtcgtacggttggaggttacaacttatgtcgtcttggtaccaacagtaccaccaggacaaacgtaccccaacgtcactagatttanggtaggtcaactaaacggccctacgaacggggtcctacgtaacgtccgtaccttaccgtcgttcgggtaccttaccgaaggttcgtggggtacctaaccgtacggggtaccctacccgtacggtaacccttactcccgttacgtacggggtaccctaccgtaggtaccgttacggaacccggtaccggacgggtccctaccggtaacttagttaagtttcgacttaggttacttacgtaattacaacgtaacgtcgaaacgttactaacgttacctacgggttccgggttaggtttacccggggacggggaacgggtacccggtaaccggttacggtaacccgggttacggtttaaccggaagtaacccggtacccggtaaacgggttccggacccggttccccccgttaggttacccccg

SEQ ID NO: 61568 - DNA, 578 bp, Homo sapiens
  misc_feature: GYAE6OF02J2F5J.37.14.B03.1.454.CMB.1.raw
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcacgtggaacccgcagtgacgttggtggttataactatgtcttcgttggtaccaacatccacccaggcaaacgtccccaaactcatgatttangaggtcactaaacggccctnaggggtctntaatcgcttctntggctcaagtctggactaacgacggcctccctgaccatctctgggctccgaggctgacgagacgctcacttnttagtgcngctctatactacagcacgctatctacgttgggtcgttcggacgggacgggaccgaccgttcgccggttacgttacggtcgacgacccgaaggctaccgccctacggtcctaccttccgtccggttccccgtcccttccgccttactaccgttacctacctacgtcggacggtaccgggtctaaccggg

SEQ ID NO: 61569 - DNA, 746 bp, Homo sapiens
  misc_feature: GYAE6OF02GBZQT.37.14.B03.1.454.CMB.1.raw
tcagtagtgtagatcacgaccggtgctcgatttagtgtgagtagttccgggactttggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcaccaggcaaagtccccaaactcatgatttatgaaggtcaactaaacggccctgaggggtctctaaatcgcttctctaggcctccaagtctggccaacacggccctccgtgacctattctcgtcgggacctccgaggtctacggacggtaccggaggtcctaccacttatttacgttcgactacgttcctactaattaacgttaaccgaaacgtacacggtacctaacgttaccgtaacggttttcggggtcggtttacggggacccggggtaacggggtaccccgtaacccgttacggtaacccggtttacgttttaacgggtccgtaaccggaccccgtaaagggtcccttacccggtaccccccgtttaccgggttcccttacccggtttccgtttccccgggtttacccccgtaccccgtttacccggttacctaaccgtttacccgttaaacccgttaaccgtttaccggtaacgggtacccgggttaccggggacccgttaaccggggg

SEQ ID NO: 61570 - DNA, 609 bp, Homo sapiens
  misc_feature: GYAE6OF02IOT2S.37.14.B03.1.454.CMB.1.raw
  modified_base (228)..(228): a, c, t, g, unknown or other
  misc_feature (228)..(228): n is a, c, g, or t
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctcgtggacagtcgatcaccatctcctgcactcggaaccnagtgacgttggtgttatactatgtctcttggtaccaacatccaccaggacaacgtaccccaaactcaatgtatttagtgagtcaacgtaacgccctgacgggtctctaatcgtctctcgtgctacctagtctggacacgaccgcctcctcgaccattcctcgtcggcctacgacgtctcgacgacggaggccttacgacttatttacgtcgactagtcctactaattactaacgaacgtaccgagcctactaccgtcggttacgggttcggttccgggaccgggtacggggaccccgtaccggttcggtaccggttaccgttacggtacccgtacgacccggaacggtcccggttacccgcccccggttccggttaacccg

SEQ ID NO: 61571 - DNA, 610 bp, Homo sapiens
  misc_feature: GYAE6OF02JAC4K.37.14.B03.1.454.CMB.1.raw
  modified_base (391)..(391): a, c, t, g, unknown or other
  misc_feature (391)..(391): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggaccaaacgtccccaaactcatgatttatgaggtcaactaaacggccctcgaggggtctctaatcgcttctctggctccaagtctggcaacgcgcctcctgacctatctcgtgggcctcgaggctgacgacgagctcactattagtgcagctnatactacaacgcagacatactacgttgggttacgttcgggacgggacgggacccgtaccgtcggtaccggtaccgttacggtcaccggacccgaacggtccgtacccggtcccccgttcgggttaccctaccgttccgttcccggtttcccccaccccgtttccctaacaccgtttaccctacctaccgtttaccggtgaccgggtccgggcgtacggg

SEQ ID NO: 61572 - DNA, 708 bp, Homo sapiens
  misc_feature: GYAE6OF02II2QH.37.14.B03.1.454.CMB.1.raw
  modified_base (187)..(187): a, c, t, g, unknown or other
  misc_feature (187)..(187): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcacatctcctgcactggaacccncagtgacgttggtggttaataactatgtctcttggtaccaacatccacccgaggacaaacgtccccaaactcatgtatttatgagtaccaacgtaaaccggccctcgagggtctactaagttccgtcttctcgtggtcctaccgtaagtcctggaccaaaccgcccgtccctccctacgacctacgtcctacgtcgggcctaccgaggtccgtacggtaaccgacggtacggtacctactaactttaagttacgttcgactacgcttactagtaactaacgaacgtacgacgactacttacgttacggttcggggtttcggttacggggaccgggtaccgggtacccgtacccgtacggtaccggttacggttacgtacgaaccggaccggtaacggcccgtcccggtcccccggttcggtaccctaccgttccgttacccgttcccgttaccttccgtaccccgttactaaccgttaccctaccgttaccgttacggtacggtacggtcccgggtaccgg

SEQ ID NO: 61573 - DNA, 732 bp, Homo sapiens
  misc_feature: GYAE6OF02IWPZU.37.14.B03.1.454.CMB.1.raw
  modified_base (267)..(267): a, c, t, g, unknown or other
  misc_feature (267)..(267): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttaataactatgtctcgttggtaaccaacatccaccaggcaaacgtccccaaatcatgtattangaggtcaacgtaaaccgcctgagggtctacgtaactcgtcttctctcggtactcgaacgttctcggacaaaccgaccggtcccttccccgtacgacctaacgttccgtccgtcgggtccttaccgaaggccgttacggaaccggtaacggacggtaccttaccgtaacttaagtttaacgtttcgaccgtaggtaccttactaacttaacgtaaaccgtaaacgacgtaacgactacgttacttaaccgggtttcgggttacggtttccggggaccgggttaccgggaacccgtaccggtacgtaccggttcgtttacggaccgtaccgacccgaaggtcccgttccgtacccccggtcgtaccgtaccgttccgttaccccgttccccctaaccccgttcctaccgtaccgttaccctaacgtaccgttaccgtaccggtaccgggtaccggtcggtaaccggg

SEQ ID NO: 61574 - DNA, 762 bp, Homo sapiens
  misc_feature: GYAE6OF02FGNC2.37.14.B03.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
tcagtagtgtagatcacgaccggtgctcgatttagtgtgagtagttccggcggggggggtctcaggaggcagcgctctcaggacatctccaccatggcctgggctctgctgctcctcaccctcctcactcgagggcacgagggtcctcgggcccagtctcgccctgacctcacgcctcgcctcgtgtctcggtcctcgtggacngtcatcaccntcctcncgcaccgtccggaccngtggtcgtcggttggtacgttaactacgtntcgtccttacgttacgaccactactaccgacccgaacggaacctaaacccgtaccctaaacgtctagttattaaactttgtacggtaaccgtaacctaaaccgggtacccgtccgtacgggttaccgggtccttaaccgttacgtccgttcttcctcgtcgtacctacgtaacgtcgtaccgaaccaaccggtccctaccctccgtaccgtacctcgtaccgtcgggtcgacccgtcggacggtccgtaaccggaccggtacgtccgttacctactaacgtttctacgtcaccgtactacgtaactaagttaaccacgacgtacctaggtacttacggtcgttaccgggttcgggtaccggggtacccggacggggtaaccccgtcccggttaaccgggtacccgttaccgggttaaccggtacccgaaccggtaccccggaaccggttccccggttaccccgtcccccgggttacccggttaccgttccccccgg

SEQ ID NO: 61575 - DNA, 558 bp, Homo sapiens
  misc_feature: GYAE6OF02FS82I.37.14.B03.1.454.CMB.1.raw
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (368)..(368): a, c, t, g, unknown or other
  misc_feature (368)..(368): n is a, c, g, or t
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcacgtcggaacccncagtgacgttggtaggttataactatgtctnttgtaccaacatcaccaggacaaacgtaccccaactcatgattatgaggtcaactaacgcctcgacgggtctactaatcgcttctctcgctcaagtctaggcaacnccgctccctgaccactctctcgggctccgaggtctgacgacggacgctcacttattattgacacgtctactatacgaactagctagactactctacgttgggtacgtcgggacggacgggtaccggtaccgtcggtaccgtcgttacggacgacgaccgtaacggtcctccggtaccccgtcgttacccg

SEQ ID NO: 61576 - DNA, 774 bp, Homo sapiens
  misc_feature: GYAE6OF02HF73X.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggacaaacgtaccccaaactcatgtatttatagaggtacaacttaaaaccggcccctacgaggggtctctaatcgtcttctcgtcggctaccgaagtcgtcggacaaacgaccggcccttaccccgtcgtaaccactctcgtcgggcctccgacggctacgacggacggacggcctactaacttattattcgactacgtcctactaacttaactaaaccgtaaacgaccgacgtacacttaccgttaacggttttcgggggttccggtttaccgggggacccggggaacgggggtaaccccgtacccggttacggtaacccggtttaccggtttaaccgggtaccgaaccggaccccgtaacgggtcccggttaccccggtaccccccggtttaccggtacccgttacccgttcccgtttaccccgggtttccccccgtacccccgttcccgttacccttaacccgttacccttaaccccgtaaccgttaacccggttcgggtaaccgggtacccggggtacggttaaccccggggg

SEQ ID NO: 61577 - DNA, 714 bp, Homo sapiens
  misc_feature: GYAE6OF02IRV1Z.37.14.B03.1.454.CMB.1.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (316)..(316): a, c, t, g, unknown or other
  misc_feature (316)..(316): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctcctcactcagggcacagggtcctggcccagtctgccctgactcagcctgcctccgtgtctgggtctcctggacaggtcgatccgacctatcctccgtggccacgtcgggaaccccngaaggttcgacgtttggnggtttaataactatgtctctgtaaccaacatcaccaggacaaacgtaccccaaactcatanactttatgagtaccaacgtaaaccgcctacgacgggtctacgtaatcgtacttctcgtagtcctactacgttcgacggactaacgaccggtccctaccttacgacctaacttccgttcgtcgggtcctaaccggtacggtacgttacggaaccgtaacggtacgggtaccttacctaaccgtttaacgtttaacgttacgtaccgtaacgtcgttacctaaagttaacgttaaaccgaacgtaccgacgtacctaagttaccttaacggtttccggggttacgttacccggggaccgggtaacgggtcccgtaaacgttccggtaaccgtttacggtaaccggttccgacggtaccccgtaacggtccggttaccccgtaccccgttacggtaccccg

SEQ ID NO: 61578 - DNA, 562 bp, Homo sapiens
  misc_feature: GYAE6OF02HK61L.37.14.B03.1.454.CMB.1.raw
  modified_base (205)..(205): a, c, t, g, unknown or other
  misc_feature (205)..(205): n is a, c, g, or t
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
tcagtagtgtagatcacgaccggtgctcgatttagtgtgagtagttccggggactttgcctgggctctgctgctcctcactctcctcactcaggacacagggtcctgggcccagtctgccctgactcagcctgcctccgtgtctgggtctcctggacagtcgatcaccatctcctgcactggaaccagcagtgatatgaaacttntaaccttgtctcttggtaccaacagcacccaggcaaacgcccccaaatcatgatttgtgaggacagtaagcggccctcgaggggtttctaatcgctttcgtctggcctccgaagtcgtggcaacgacggtcctccctgacaactcncgtgggctccgaggctaggacggtacgaggctgatttacttactgctgctcatntgactaggtatctacttcttatcgttcgtacgacgtcgggacctaaggtcaccgtcctaagtccacgacccgaacggcccaacccacgtcgtaccgtaccttcgtaccgttccccgtaccctccgtactacgtcctacctactaccgtgacgtccgg

SEQ ID NO: 61579 - DNA, 776 bp, Homo sapiens
  misc_feature: GYAE6OF02JAZZ1.37.14.B03.1.454.CMB.1.raw
tcagtagtgtagatcacgaccggtgctcgatttagtgtgagtagttccggggactttggcctgggctctgctgctcctcaccctcctcactcagggcacagggtcctgggcccagtctgccctgactcagcctgcctccgtgtctgggtctcctggacagtcgatcaccatcctcctgcactcggaacccgcagtgacgttggtggttatactatgtctcttgtaccaacatcaccaggcaaacgtaccccaatcatgtatttatgaggtacacgtaaaccggccctacgaggggttctacgtaactcgtcttctctggtcctcaagtctggaccaacgaccggtccctcctcgacctactccgttccgtcgggtcctaccggtacggccgttacgggaacgtacggaacggtcgtacctaccgttaattttaacgttcggtccaagtccgtactaaacgttactaaaccgaaacggtactaacggtacctaacgttacccgtaaccgggttttggggggttaccggtttacccggggtacgggggtaaacccgggggtaaccccgtaccggttaacccgggtacccgtttaaccgggtttacgggtaacccgtaacgggtaccccggtaacgggtacccggttaccccggtaaccccccggttccggggttacctacccgtttccgttacccgggttccccctaccccgtttcccgtaccttaccttccgttaccgacccgtttacggaccgtacggggtcccggtcggtacggg

SEQ ID NO: 61580 - DNA, 510 bp, Homo sapiens
  misc_feature: GYAE6OF02G1EW6.37.14.B03.1.454.CMB.1.raw
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaacgtccccaaatcatgatttatgaggtcactaaacggcctcgaggggtctactaatcgacttctctggctccaagtctggcaacaccggcctccctgaccatctcgtgggctccgaggctgacgacgagctcactattntgcagcnatanaacancancatcagttggtgtcggngagggcctactcgaccgttctagcacgtccgagcctcgccccgtgtcnctcgtcgtccccncctcctacnctctacnctcgtgcgcggcacgg

SEQ ID NO: 61581 - DNA, 608 bp, Homo sapiens
  misc_feature: GYAE6OF02IO60T.37.14.B03.1.454.CMB.1.raw
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (604)..(604): a, c, t, g, unknown or other
  misc_feature (604)..(604): n is a, c, g, or t
tcagtagtgtagataaacacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccgaggacaaacgtccccaaactcatgtatttatgaggtcaactaaaccggccctcgacgggtctactaactcgcttcctcgtcggctccaagtctggaccaacgaccggcccttaccgtcgacctactctaccgtcgggcctccgacggtctacggaacgacggaggcctactaacttattattcgcacgtctacaattaactaacaacgtcaacgacctaagtaccgtacgtttggggttcggttccgggacgggaaccgggtacccgaccgtcgtaccgttacgttacggcgacgaccgagccgtcgcccgtagtccacgtctccgtcccnccctcncctactacctacactcacggcgtccgntcgg

SEQ ID NO: 61582 - DNA, 563 bp, Homo sapiens
  misc_feature: GYAE6OF02J2JLV.37.14.B03.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
  modified_base (531)..(531): a, c, t, g, unknown or other
  misc_feature (531)..(531): n is a, c, g, or t
tcagtagtgtagatcacgaccggtgctcgatttagtgtgagtagttccgcgggggggtctcaggaggcagcgctctcaggacatctccaccatggcctgggctctgctgctcctcaccctcctcactcagggcacagggtcctgggcccaggtctcgccctgactcagcctgcctccgtgtctgggtctcctggacagtcgatcacntctcngcactggaaccctnagtgacgttggtgttaatactatgtctcgttaggtaccaactactcacccaggacctaaacgtaccccaaataccatgtaatttnagacggtcctaacgtaaaccggcccttggaacgggttctactaacgtcgtctctcgtcgctacgtagtcnggacacgacgcctccngacctntcctcgtggcctccgngactggacgcgcgacgtcaccgttnttacgtgcgatccanactagtaacacgtacgancgtaactcgtacgtcggtggttccgagggacgtacgcctagcgttacgttacgnaccgcccgaagtccgtccggtccctggtaccc

SEQ ID NO: 61583 - DNA, 783 bp, Homo sapiens
  misc_feature: GYAE6OF02JTASB.37.14.B03.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
tcagtagtgtagatcacgaccggtgctcgatttagtgtgagtagttccggcggggggggggtctcaggaggcagcgctctcaggacatctccaccatggcctgggctctggctgctcctcaccctcctcactcgagggcacgagggtcctgggcccagtctgccctgactcagcctgcctcgtgtctgggtctccgtggacngtcgactcaccattccnccgttgacctacgtcgggaaccccgcaggtcggtacggtttgggtaggtttaactaacctnttgtaccttcgttacggtaaccaaactactacccgaacccagggtacctaaaaccggtacccctaaactcgtacttaggttaatttacgcggtacggtaccaaccgtaaacggtccccgtacggacgggttcctagttaactccgtctttccgtcgtcggcttaccgtaagggttcctacgggaacctaaccgtacccgggtcccttaccctacggtaccctagttcccgtacggttccgggcttacccgacgggtaccgtaagggtaacccgaacggtacggttacccttaactacgtttactttacgttacgcctagtacctactaagtttaaccgaacgacggtacaccgtcgttaacgttaccgttaacgggttggttaacgggttcccgggaccgggacgggttacccgaaccggtttcgttaccgggtttaccgttacgggtaccctacggggtacccctaccggggtaccctaccggttcccccgacggtttaccc

SEQ ID NO: 61584 - DNA, 644 bp, Homo sapiens
  misc_feature: GYAE6OF02HVVBO.37.14.B03.1.454.CMB.1.raw
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactggaacccgcagtgacgttggtgttaataactatgtctcttggtaccaacactcaccaggacaaacgtccccaaactacatacgtaatttatgaggtacacgtaaaccgccctagagggttctctaatcgcttctctgctacagtctcggacaacgacgtccctacccgtcgaacctctctcgtcgggtcctccgaggtctagacgacggacggtcacgtactaatttacgtcgactacgactacgtaataacgttaacgaacgtacgacgactaacgttaccgtacggttcgggttacggtaccggggtacggggtaacggggacccgtaccggtaccggtaacccggtttaccggttaacggtacccgtacggtaccccgtaacgggtcccgtacccggtccccccggtacggttaccccgg

SEQ ID NO: 61585 - DNA, 591 bp, Homo sapiens
  misc_feature: GYAE6OF02G00JV.37.14.B03.1.454.CMB.1.raw
  modified_base (231)..(231): a, c, t, g, unknown or other
  misc_feature (231)..(231): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatccaccatctcctgcacgtcggaacccnagtgacgttggtgttataactatgtctcttggtaccaacatccaccaggacaaacgtaccccaaactcatgtattagtgtagtacaacgtaaccggcctacgtacgggtctactaatcgtcttctctcgtctccgaatcgngacaacgccgtcctccgtcaccntctcgtcggcctccgcggtctacggacgacgtacggcctactacttattagttcgctacgtctacattaacgtaacacgacacgtacacttcgtacgttgggtacgttcgggcgggtacggtacccggtacgtacggtaccgttcgttacggtacaccggacccgaggtcccgtacccgccccggttacggtaccc

SEQ ID NO: 61586 - DNA, 738 bp, Homo sapiens
  misc_feature: GYAE6OF02IM34L.37.14.B03.1.454.CMB.1.raw
  modified_base (598)..(598): a, c, t, g, unknown or other
  misc_feature (598)..(598): n is a, c, g, or t
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctcgccctgactcagcctgcctcgtgtctgggtctcctggacagtcgatcaccatctcctgcactcggaacccgcagtcgtacggtttggtaggttaataactagttcgtcttcgttcggtaacccaaactactccaacccgaggtacaaaccgtaccccaaaactccaattcggtaatttaagtggtaacggttaccaaaccgttaaaaccggtccccgtacggtacggggttaccttactaaacgttcgtctttcctcgtcggtcctaccgtaagttcgtacggaccaaccgacccggtcccttacccgtacgaccctattccgtcgtcgggtacctccgacggtcgtacggaaccggaccggacggtaccttacgtaactttaacgtttacttcgaccgtactcgttactaactaacgtaaacgagaccgagtaaccgtntaccgtacggtttaggggttcgggtttaccgggacgggtaaccgggtacccggtaccggttacggtacccggttagttaaccggtaccgtaccggtacccggtaaccgggtccctacccggttcccccgtaccggtaccc

SEQ ID NO: 61587 - DNA, 583 bp, Homo sapiens
  misc_feature: GYAE6OF02GORVQ.37.14.B03.1.454.CMB.1.raw
  modified_base (394)..(394): a, c, t, g, unknown or other
  misc_feature (394)..(394): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgagtcactaaacggccctcaggggtctctaatcgcttctctcggctccaagtctggcaacacggcctcctgaccatctctgggctcagctagacgacgagctcactattattgcagctcatatacaagcancatcacgttgggtagttcggacgggacggaccgtacctggtaccgtcgttacgggtcacggcccgtaagggcccgtccgtacccccgtcggtcctaccgttcgttacccgttcccccgtacccttccccgttacaccgtttaccctaccgtaaccttaccgtacggtaccggtccgggtcgttaccggg

SEQ ID NO: 61588 - DNA, 675 bp, Homo sapiens
  misc_feature: GYAE6OF02IR807.37.14.B03.1.454.CMB.1.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
tcagtagtgtagatcacgaccggtgctcgatttagtgtgagtagttccgcggggggggtcgtcgaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccncagtgacgttggtgttataactatgtctcttggtaccaacntacaccaggacaaagtaccccaaactcactgtatttatagaggtacaactaaaacggcctcgacgggtctactaatcgtcttctctggcctactaagtctggcaacgcgcctccctgacctactctaccgtgggccctacgaggctaggaccgtacggtaggcctactaccgttaagtttaacttcgaccaaggtcctactaactaacgttaaccgaaacgtaccgaaggtacctaaagttcccgttaaacccggttttgggggtttaccggtttaccggggaccggggtaccggggtaaaccccggtaccggttaccgggaacccggttttacggttaaccgggtcccgtaaccggtaccccgaaacgggtcccgtcccggtaccccccgttcgggttaaccccg

SEQ ID NO: 61589 - DNA, 602 bp, Homo sapiens
  misc_feature: GYAE6OF02FTTV7.37.14.B03.1.454.CMB.1.raw
  modified_base (232)..(232): a, c, t, g, unknown or other
  misc_feature (232)..(232): n is a, c, g, or t
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
tcagtagtgtagatcacgaccggtgctcgatttagtgtgagtagttccgcgggggggggttcttcgaggaggcagcgctctcaggacatctccaccatggcctgggactctgctgctcctcaccctcctcactcagggcacagggtcctgggcccagtctgccctgactcagcctgcctccgtgtctgggtctcctggacagtcgatcaccatcctcctgcactggaacccnagtgacgttggtgttataactatgtctcttggtaccaactactcgacccaggacaaacgtccccaaaactcagtgatttagngaggtcaacgtaaacggccctagagggtctcgtaancgtcttctctggctaccaagtctggacaacgccgtcctcccgtgaccatccgtactcgggctccgacggtctacgaccgacgacggtcctacgtaacttactttacgttcgacgacgtcctacctaattactaacaagactacgctaactcgtaacgtttcggggtcgttacgggacgggtacgggtacccgtacgtcggtaccgtcgtttacggtcacggtcccgaacggtccaccggtccccgtggtacc

SEQ ID NO: 61590 - DNA, 619 bp, Homo sapiens
  misc_feature: GYAE6OF02FQE2M.37.14.B03.1.454.CMB.1.raw
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatccacccaggccaaacgtccccaaatcatgtattatgagtcactaaacggccctcgaggggtctctaatcgtcttctctggcctccaagtctggcaacgaccgccctcctagaccatctcgtggcctccgacggtctcggacgacgacggtctcacttatttactgctacgtctctaataactacgaagctacgcactcgtacggtttgggtcggttcgggaccgggacggacccgtccgtcgtaccgttacggttacggtcgaacggtcccgtaacgggtcctcccggtaccccgttcgccgttacctccggttacccgttcccccgtcccttaccctcgttacctaccgttacctaccgtacgtaccggaccggtcggtcgtacggg

SEQ ID NO: 61591 - DNA, 831 bp, Homo sapiens
  misc_feature: GYAE6OF02HOWRJ.37.14.B03.1.454.CMB.1.raw
  modified_base (179)..(179): a, c, t, g, unknown or other
  misc_feature (179)..(179): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
tcagtagtgtagatcacgaccggtgctcgatttagtgtgagtagttccggcggggggggtcgtcgaggaggcagcgctctcgaggacatctccaccatggcctgggctctgctgctcctcaccctcctcactcgaggaacacgtacgggtccgtcgggaccctagtctcgccctagacncagcctcgcctccgtgtcgtcgggtctccgtggacngtcgatccaccatccttcgngacctacgtaggaaaccagtacgagttagaaatttacttaacgtaaaactttaacttaaaccttgtacttcttacgggtaaccaacgagtaccgaacccaggacaaaacccgacccaaactacatacgtagttgagacgaacgtaggtaacgccggcctacggtaacggggtttactaaacgtctcttccgtgtacggtacctcgtaaacgttcgtacggtaacaaacccgtaccgggtcccttacccggtagtaacctaaacgttaccgtccggttaccggggtcccgtaacccgtcgggtaccggtacgggaaacggggacggtaacggggtaccttaaggtaacgttttacgttaaaccgttccggtcgttacgtccttacggtaaacttacgggtacgtacgggttaacggttaaccgtacctttaactttaccgttaacgttccgtttaaccgtacccgggtttaaaccgggaaccgggtaaacccggtaacggttacccgtaaaccggtttaaccggtaacccgttaaccggaacccggtaacccgtaaaaccccggggtaaaccccttaaccccgtaccgtttaacccg

SEQ ID NO: 61592 - DNA, 723 bp, Homo sapiens
  misc_feature: GYAE6OF02GX63J.37.14.B03.1.454.CMB.1.raw
  modified_base (238)..(238): a, c, t, g, unknown or other
  misc_feature (238)..(238): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtcgtggtctccgtggacagtcgatccacctattcctcctgcctacgtcggaaccccgnaggtcggtacggttggtaggtttaataactatcgtctcgttcggtaaccaacactccacccgtaggaccaaaccgtaccccaaacttccaattacgtattttagtaggtaacggtacctaaccggttaaaaccgggccccttacggacggggttcttacgtaacgttccgtcctttcgtcgtcggtacctaccgtacgttcgtacggacaaccgtaccgtccctacccgtcgaccctagtcgtcgtcggtctcgacgcgtacgacgtacgacggacctactacgttattacgtacgcgactctaactactaacgtaacaacgcaacggtacctagttacccgtacgggtttcgggttaccgggttaccgggtaccggggaaccgggtaccccggtaccgtacgggttaccccggtacggtttacggtcccgaacggtacccgtaacgggtccccttacccggtcccccggttcggttaaccccgg

SEQ ID NO: 61593 - DNA, 627 bp, Homo sapiens
  misc_feature: GYAE6OF02HVOGZ.37.14.B03.1.454.CMB.1.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (338)..(338): a, c, t, g, unknown or other
  misc_feature (338)..(338): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacgacgggtcctgggcccagtctgccctgactcagcctgcctccgtgtctgggtctcctggacagtcgatcacatctctgcactcggaaccnagtgtacgttggtgttaatactatgtctcttgacaanatcaccagacaacgtcccaaatcatgtattatagagtacacgtaaacgcctagacgggtctactatcgtcttcnctgtcacgtagtctcggacacacgccctcctacacgtctctcgtcggcctccgagcctggaacgacgacggtcctacgtaacttacgtttatcgtacgtaccgtactacctaattaaccgtaacgtaacgactaacgcctaacgttcgtaacgttcggggttagttacccgggtacgggaccggggtaaccgtcccggttaacggttaccggttaccgtttacgggacccggttaaccgaccccgtaaccgggtcccggtacccgttccccccggttacgttaccccgg

SEQ ID NO: 61594 - DNA, 886 bp, Homo sapiens
  misc_feature: GYAE6OF02IFHCY.37.14.B03.1.454.CMB.1.raw
  modified_base (215)..(215): a, c, t, g, unknown or other
  misc_feature (215)..(215): n is a, c, g, or t
tcagtagtgtagatcacgaccggtgctcgatttagtgtgagtagttccggggactttgcctgggctctgctgctcctcacctcctcactcagggcacagggtcctgggcccagtctgccctgactcagcctgcctccgtgtctgggtctcctggacagtcgatcaccatctcctgcactcggaacccgcagtgtacgttggtagttataactatntctcttaggtaccacatccaccgaggacaaacgtcccaaactcaagtgtaactttagtacgtaggtccaacgtaaaccggcctaggacgggtctactaactcgtaccttctacgtgctaccgtaagtcgtgactaaccgaccggtccctccgtacgtacctactacgtcgtacgggtctccgaggtctcggtaacggacggtacggtacctcgtactttaaggttactttacggacgtacggtaccttaactaacgtttaaacgtaaacgtaaccgtaacgtaacggtacctaaacgtttccggtaaaccggttttgggggttaccgggttaacccggggtaaccgggggtaaccggggtaaaccccggttacccgggttacggttaaaccccggtttaccgggtttaaacccggggtcccttaaacggggaacccccggttaaaccggggtaccccgtttacccgggtacccccccgtttaacggggtttccccgtaaacccggtttttccccggttttccccgggttttaaccccccggtccccccgtttaaccggttaaacccccgtttaccgttttaaccccggttaaacccgttaaccccggtttaaaccgggtttacccgggggaacccgggtttacccgggggttaccccgtaaacccgggggg

SEQ ID NO: 61595 - DNA, 618 bp, Homo sapiens
  misc_feature: GYAE6OF02HJSEP.37.14.B03.1.454.CMB.1.raw
  modified_base (559)..(559): a, c, t, g, unknown or other
  misc_feature (559)..(559): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaatcatgatttatgaggtcaactaaacggccctgagggtctctaatcgcttctctggcctccaagtctcggcaaacgccggcctccctgaccatctcgtggcctcaggtctgacgacgacgctacaacttattagtttcgcctagtcctacgtaacttaactaacaacgtacaacgcaacttaccgtacgtttggggttcggttaccggggacgggacgggtacccgaccttcggtaccgttacgttacggtccaagacccgaacggtcgtccgcccccgttggtcctacttccttccggttacccccncccttccctacctaccttactaaccgtacgttaccgacggtcggtaccggtcgtaccgg

SEQ ID NO: 61596 - DNA, 760 bp, Homo sapiens
  misc_feature: GYAE6OF02GQB1Y.37.14.B03.1.454.CMB.1.raw
  modified_base (187)..(187): a, c, t, g, unknown or other
  misc_feature (187)..(187): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaaccngcagtgatattagaaacttataaccttgtcttcttaggtaccaacagccaccaggacaaacgacccccaactcatgtattgtgagacagtaacgcgcctcgtagggttactaatcgtcttcgtcgtcggcctacgtaagtccgtacggtacaaaccgtccgtcccttccctagaacctacttaccgtccgtacggctacccgaagggtccgtagggtaacgggaacggtaacggtacgttaacggttaattttaactttaaccggttgtaccggttcgtaccttacgtaatttacgtacggaccggttaagggttaccgtacctaacgtttacctttagtccggtttaccggttaacggaaccggtacggtaaccgtaacgggttaccctaccggttacccttaaacgtccgaaccgtaaccccgaaaccggtacccctaaaccccgttacttaccgtaccctaacccgtttcccgttccccggtttccccccgtaacccctttcctaacccgtcctttaacccgttaaccgtaacccgttacccggtaggtacccggggaccgggtacccgg

SEQ ID NO: 61597 - DNA, 696 bp, Homo sapiens
  misc_feature: GYAE6OF02HOV3W.37.14.B03.1.454.CMB.1.raw
  modified_base (207)..(207): a, c, t, g, unknown or other
  misc_feature (207)..(207): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcacatctcctgcactggaacccgcagtgacgttggaggtttanaactatgtctcttaggtaccaacactcaaccccgaggacctaaacgtccccaaaactctaatacgtaatttaatgtaaggtcaactaaaacggcccctaggacgggtctacctaatcgtacttctactggtcctaccaagtctggacaacacggcctccctagacctacgttcctacggtcgtacctccggagtcgtacgaccggacgtacgtctacgttattacgtttacgcgaaccgtagtccagttaactaaccgtaacgtagcgtaacgtactacgttacggttacggttcggggtttacggaccggggttacgggaacccgtaccggttaccgacgttaccggttaccggtacgtaaccgacccgtaaccggttccgcccgtacccgtaccccgtacgtccttaccgggtccttaccccggtcgttacccctcgtaacctctaaccgttccctaagccggttacggccggtcggtactaccggg

SEQ ID NO: 61598 - DNA, 653 bp, Homo sapiens
  misc_feature: GYAE6OF02HVXGA.37.14.B03.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggaaccaanatcaccaggacaaaacgccccaaactcatgtattgtgagacagtacgcgcctgtagggttactaatcgcttcncgtcggcctacaagtctaggacaacgacgcccttccagtactaactctcgtcgggcctcgacggcgtagacggaacgagtactagtaactttaattacgtcgtacgtgacctataagttacgtagacgtaggtacgtcacgttacttagttcgttacgttacgggtaacgtacgggaacctaaaggttccctaacgttacccgaaagtaccgaccgacccgtaaaccgacccctaaaccctacgttaccgtacctacgttccgttacccggttcccccgtaccctttaccgtaccgaacttacccgtactaacgttaccgtacgggtacgggtaccgggtccgtaaccggg

SEQ ID NO: 61599 - DNA, 690 bp, Homo sapiens
  misc_feature: GYAE6OF02HT7OH.37.14.B03.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (494)..(494): a, c, t, g, unknown or other
  misc_feature (494)..(494): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcaggcacagggtcctgggcccagtctgccctgactcagcctgccctccgtgtctgggtctcctgacngtcatcacatctcctgcacgtcggaacccntagtgtacgttggtgtttaataacttagtcgttctcttacggtaccaactactccacccgaggaccaaaccgtaccccaaactcacttagtaatttacgaggtacgtaccaactaaaccggtcccctacggtacgggtcttactaatcgtcttctctcggtctactaacggtctacggaccaaccgtaccgtcccttccgtacacctacttccttcggttacggcctaccgaggtcccaggaaccgacgacggtctactacttatttntcgtacatccgtactaacgtataacgaacgtaccgatactacgttaccgtacggttcggggttccgggttaccgggaccggggtaaccggggtacccgtaccggttaaccgggtacccgtttacggttaaccgggtaccgacccggtaccggtaaccggtacccggttccccggttacccccgtcgggttaccccg

SEQ ID NO: 61600 - DNA, 608 bp, Homo sapiens
  misc_feature: GYAE6OF02IZPUO.37.14.B03.1.454.CMB.1.raw
  modified_base (158)..(158): a, c, t, g, unknown or other
  misc_feature (158)..(158): n is a, c, g, or t
  modified_base (231)..(231): a, c, t, g, unknown or other
  misc_feature (231)..(231): n is a, c, g, or t
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacgagggtcctgggcccagtcncgccctgactcagcctgcctcgtgtctgggtctctggacagtcgatcacatctcctgcacgtggaaccccgtnagtgacggtttggtgttaatactatgtctcgttggtaccaacactcaacccaggacaacgtcccaaactcatgtattatgacgtcaactaaaccggtcctcgacgggtctactaatcgtcttctcgtcggctacagtcgtcgacaacgacgccctcctacgacctatccgtacgtcgggtctccgacggctggaccgacggacgactctaacttacttacttcgacacgtctactactaactaacgacacgacgtactaactctacgttcgggttacgttcgggacggacgggtacccgaccgttacgggtaccgtttcgtacggtaccaccggtcccgtaaacggtcccgtacccggtccccggtacgttaccccg

SEQ ID NO: 61601 - DNA, 665 bp, Homo sapiens
  misc_feature: GYAE6OF02FMRCO.37.14.B03.1.454.CMB.1.raw
  modified_base (188)..(188): a, c, t, g, unknown or other
  misc_feature (188)..(188): n is a, c, g, or t
  modified_base (230)..(230): a, c, t, g, unknown or other
  misc_feature (230)..(230): n is a, c, g, or t
  modified_base (263)..(263): a, c, t, g, unknown or other
  misc_feature (263)..(263): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccncagtgacgttggtggttataactatgtctcttggtaccaacntcaccaggcaaacgtccccaaatcatgatttangaggtcaactaacggccctgacgggtctctaatcgtcttctcgtgtctaccagtcgtgacaacgaccggtcctccgtcgacctatctacgtcgggctccgaggctaggacgacgacggtcctctaacttaagttacgtcgactagtctactaatactaactaacgctacgactacgtctaagggtttcgggtacgtttccgggacgggtaaccgggacccgttaccgtacggtacccgttacggttacggtaccgaccggtaccgaacgggttcccgtaccgttcccccggtacgggtacctaccggttcccgttacccggttaccccctccctacccgttccgtacgttacccgtaccctacgttaccggtacgggtacccggtacgggttccgtaccggg

SEQ ID NO: 61602 - DNA, 685 bp, Homo sapiens
  misc_feature: GYAE6OF02HZNWB.37.14.B03.1.454.CMB.1.raw
  modified_base (237)..(237): a, c, t, g, unknown or other
  misc_feature (237)..(237): n is a, c, g, or t
tcagtagtgtagatcacgaccggtgctcgatttagtgtgagtagttccggcgggggggggtctcaggaggcagcgctctcaggacatctccaccatggcctgggctctgctgctcctcaccctctcactcgagggcacgagggtcctgggcccagtctgccctgactcagcctgcctccgtgtctgggtctctggacagtcgatccaccatcctctgacctacgtacggaaccccgngaggtgtacggtttggtacgtttaataactatgttccttcttaggtaccaacacgccaccgaggacaaaccgaccccaactccatcgtattggtagacgacagtaacggccgtcccgtagtagggtttacagttcgtcttctcgtgtcctacaagtctcggacacgaccgtcctacctagactacgtaccgtcgtacgggctaccggagtcgtggaacggacgtacggcgttaagtactttaacgttacgcgttcgtcgtacctagtagttacgtacgtaccgtaaggttaactccgtaaccttttacgttacgttacggttaccgttaccgggtaaccggttacgggtaacccggtaacgggttaacccttacccggttaccgttaacggccgttaacccggaccgtaaaccccggtaaccccaaccccgttagacccgtttaaccc

SEQ ID NO: 61603 - DNA, 608 bp, Homo sapiens
  misc_feature: GYAE6OF02FZ5FO.37.14.B03.1.454.CMB.1.raw
  modified_base (508)..(508): a, c, t, g, unknown or other
  misc_feature (508)..(508): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacactcacccaggacaaaacgtcccccaaaactcatcatttttgaggtcactaatccggccctcaggtaatttcttctcgtcttctctgcctccaagtatggcaacacggcctcttcgaccatctcgtgggcctccagactggacggacgaggtctgtatttacttactgctagttcattaataggacggcgaaccaactactttatggttccttacgggaagtcgggaacctaaggtccgtcggtacctaaggtccacgacccgaacggcccaaaccccncttacgtactaccttcgttaccgttccccgccccttccctacctacctaccttaacctaccttacgtacggacggtccgggtactcgggacgtaaccggg

SEQ ID NO: 61604 - DNA, 737 bp, Homo sapiens
  misc_feature: GYAE6OF02JHTPH.37.14.B03.1.454.CMB.1.raw
  modified_base (192)..(192): a, c, t, g, unknown or other
  misc_feature (192)..(192): n is a, c, g, or t
  modified_base (209)..(209): a, c, t, g, unknown or other
  misc_feature (209)..(209): n is a, c, g, or t
tcagtagtgtagatcacgaccggtgctcgatttagtgtgagtagttccggggactttggcctgggctctgctgctcctcaccctcctcactcagggcacagggtcctgggcccagtctgccctgactcagcctgcctccgtgtctgggtcctcctggactagttcgatcaccatctcctgcactggaaccgnagtgacgttggtgttanaacgtatgtctcgttggtaccaactagtccaacccaggaccaaaacgttccccaaaacttcaatcggtatttactggtaggttctaaccgttaaaccggtcccctcgtaacggggttaccttacgtaaacttccgtccgtttctccgttcggccgttaccgtaaggttccgtaggaccgtaaccgaccgggtccccttacccgttacggaccctaacgttacgttccggtacggggtacccttaccgaacggttccgtttaacgggacccggaaaccgggtaacgggtccctacggttaaccttaagtttaacgtttcgcgtaacgtcctactaacttaacgtaacgtaacgacaagacctacgtaccttacggttgggttacgttccgggacgggacgggtacctaccgtcgtaccgtcgttacggtacaacggcccgaacgtctccggcccgtcgtacctcctcgtcccgtcctaccctcgtacctataccgtactacgttacgtcggacggtccggtgtaccggg

SEQ ID NO: 61605 - DNA, 776 bp, Homo sapiens
  misc_feature: GYAE6OF02GUEDA.37.14.B03.1.454.CMB.1.raw
  modified_base (224)..(224): a, c, t, g, unknown or other
  misc_feature (224)..(224): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctcgtgtctgggtctctgacagtcatcacatctcctgcactacggaacccnagtgtacgttggtagttataactatgtcttcttggtaaccaactactaccacccgaggacaaacgtaccccaaactcatacgtatttagtagagtactaacgtaaccgcctcgtagggtactctaacgtcgtcttacgtcgtcggacttaccgtaacgttccgtacggacctaacgtacccggtccctacccgtacgtaacctaccgttaccgttcggttaccggtcccgttacgtaacgggtccggttaaccgaacgggtaaccgggtacgggttacccttaaccgttaacgttttaacgttaaccgtttcgtaccgtaacgttacccttaaccggttaacttaaacgttaaacgtaacgtaccaaccggtaccttaacgtttacccggttaaacgggtttccggggttacgggtttacccggggtacggggtaaccgggtaccccgggtaaccgttaccgggtttaacccgggttaacgttaccgggtacccgacccggtacccggtaaccggtccccgtaaccccggtcccccgtacggtttacccccg

SEQ ID NO: 61606 - DNA, 765 bp, Homo sapiens
  misc_feature: GYAE6OF02G30SZ.37.14.B03.1.454.CMB.1.raw
  modified_base (188)..(188): a, c, t, g, unknown or other
  misc_feature (188)..(188): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccnagtgacgttggtgttataactatgtctcgttgtaccaacataccaccgaggactaaacgtaccccaaatcatagtatttatagagtacaactaaccggcctcggagggtctactaatcgtacttctctcggtcctaccgtaacgtcgtacggacgaaccgtaccggtccctccctacgtacctacgttccgtcgtacggccttaccgacggtcgtacggaaccggacggacggtcctaacgtaactttacttaacgttcgacgtacgtacctactaattaactaacgaacgacgaacgtcgacgttacgttaccgggtttacggggttacgggttacccggggaccggggtaaaccgggtaacccgtaccggttaccggttacccggtttacggtttaaccgggtacccgtaacccgggtaccccgaacgggttacccccgttacccggccccccgggtttaacgcccgttaccgtttcccgtttaccccggttcccccttaaccccgttcccttccgttaaccgttaccttaaccgttaccgtacggttaccgggcggtaccgggtcgtaccgggg

SEQ ID NO: 61607 - DNA, 820 bp, Homo sapiens
  misc_feature: GYAE6OF02IDC3I.37.14.B03.1.454.CMB.1.raw
  modified_base (249)..(249): a, c, t, g, unknown or other
  misc_feature (249)..(249): n is a, c, g, or t
tcagtagtgtagatcacgaccggtgctcgatttagtgtgagtagttccggcggggggggggtctcaggaggcagcgctctcaggacatctccaccatggcctgggctctgctgctcctcaccctcctcactcagggcacgagggtcctgggcccagtctgccctgacctcacgtcctgccctccggtgtccgtgggttcctccgtggacaggtcgactcaccactctcctgaccacgtacgggaacccncgaggtggtacggttggttgttaataactgtgttcttcgttacggtaacccaactactacccaacccgaaggaccctaaaacccgtaaccccctaaaatccaagttacgtttaacttttaagacggtacggttaacccaaaccgttaaccccgggacccgttacggtaacggggtttaccttacttaaccggttccgtccgtttaccgttcccgttcggtaccttacccgtaacgggttccgtacggaaacccgtaaccggaaccccgttccccttacccgtaaccggtaaccctaccggttaccgtttccggtccgggtaccccgtaccgggtacggacggttaccggaacggacccgggtaaacgtccgttactaactttagtttacgttcgactacgttccataactaaatacgacacgactctaacgttcgttaggttcgggtttacgggcgggtaccgggtaaccgggtacccggtaccgtaccggttacccggttacggttaccggacccgtaccggtacccggaccggtacccgttacccggttaccccccggttcggtacccc

SEQ ID NO: 61608 - DNA, 804 bp, Homo sapiens
  misc_feature: GYAE6OF02H5K27.37.14.B03.1.454.CMB.1.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacgagggtcctgggcccagtctcgccctgactcagcctgcctccgtgtctggtctccgtggacagtcgatccacactctccngaccacgtcggaacccgntaggtcgtacggttggtagttaataactagttcgttcttacgttcggtaaccctaaacgtacttacccaaccccgaggaacctaaaaccgtaccccctaaaactccgtaagttcgttaatttttagacggtaacgtaccgtaaaccgttaaacccgggtccccttaacggtaacgggggttaccttaccgttaacgttaccgttcctttccgttaccggtcgttacctacccgtaaagttccgtacggtacccaaacggtacccggtacccgtcccgtacggacccctaacgttccgttccggttccgggtaccttcccggaacgggttccgtaaccgggtaacggaccgtaaccgggtcttaaccgtaacgtttaactttaggttaccgacaacgttcctacttaacgtaacgttaaacgaacgacaacgtacttaacgttccgtaaacggtttcggggttacgtcggggaccgggtaacgggtacccgtcggtaccggtaaccgttcgtacggtaaccgtacggtaacccggtaagtcccggtacccgttccccggtcggttacccg

SEQ ID NO: 61609 - DNA, 635 bp, Homo sapiens
  misc_feature: GYAE6OF02J02NF.37.14.B03.1.454.CMB.1.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
tcagtagtgtagatcacgaccggtgctcgatttagtgtgagtagttccggggactttggcctgggctctgctgctcctcaccctcctcactccagggcacagggtcctgggcccagtctgccctgactcagcctgcctccgtgtctgggtctcctggacagtcgatcaccatctcctgcactggaacccgcagtgacgttggtggttataactatgtctgttggtaccaacatccgaccaggaccaagttaccccaaatcataatttactgagtcactaacggccctanaggtattctaagtcacttcntgctaccagtctggccaacncgaccctcctgaccnttcncgtggcnccgaacctggacggtaccggagcctactactacgttattcgactcgctcgactatacaagtacaggtcgtacgtacgttggttggttccgggcggtaccgggtaccgccgttacgccgttcggttaacggtcgaccgtcccgtaacgtccgtaccgtacccccgtccgtacctaccttccgttacccttcccgtacccgtaccgttaccgtaccgtttaccgtacccgttaccgtacgttacggtccgggacccgggttcgtccggtaccgtacggtccg

SEQ ID NO: 61610 - DNA, 644 bp, Homo sapiens
  misc_feature: GYAE6OF02GRI6B.37.14.B03.1.454.CMB.1.raw
  modified_base (158)..(158): a, c, t, g, unknown or other
  misc_feature (158)..(158): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacngtcgatcaccatctcctgcactggaacccgcagtgacgttggtgttataactatgtctcttgtaccaacatcaccaggacaaacgtaccccaaactcatgtatttatgagtacacgtaaaccgcctcgagggtctactatcgtcttctcgtgcctcagtcnggcaacgcgcctccngaccntctcgtggctcgngtctgacggacgacgtctactacttattacgtacgacacgtacttacgtaataactaacgaacgtacacgactaataccgttaggtttacgggttcgggtttcgggacgggtaaccgggtacccggtaccgttaccggttacccgttacggttcggtaccgtaccggacccggtaacggtcccgtacccggttccccgtaccggtcctacccgttccgttacccgttccccctacccgttccctaccttacctaccgtacctacgttaccgtggacggtccgggcgtacggg

SEQ ID NO: 61611 - DNA, 720 bp, Homo sapiens
  misc_feature: GYAE6OF02FTDOT.37.14.B03.1.454.CMB.1.raw
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacgagggtcctcgggcccagtctcgccctgacctcagcctgcctccgtgtcgtgggtcctcgtggacagtcgactcaccatcctctncactcggaaccnagtgtacgttggtagttatactatntctcttagtaccaanctaccaccgagactaaaccgtaccccaaactcagtatattagtagtacgtacaaccgtaacggcctacggtacgggtctactaatcctcttctcgtacgctactagtcgtacggaccaacgtaccgtcccttcccgacgtacctacttccgtcggtcggtcctaccgacggtacgtacggaaccgacggaccgtaccaccgttaacttactttacgttacgtacgtacgtcccttaagtaacttaacgaacgtacgaccgtagtaaccttaacgttaccgttacgggttttcgggttaccggggttaccggggtaccggggtaacccgggtacccggttaacccggtacccgggttaacccggtttaaccggttaacggtacccgaacccggtaccgtaacccgggttccccgtaccccggtacccccggttccggtaacccccg

SEQ ID NO: 61612 - DNA, 697 bp, Homo sapiens
  misc_feature: GYAE6OF02JKMMF.37.14.B03.1.454.CMB.1.raw
  modified_base (238)..(238): a, c, t, g, unknown or other
  misc_feature (238)..(238): n is a, c, g, or t
tcagtagtgtagatcacgaccggtgctcgatttagtgtgagtagttccggggactttgcctgggctctgctgctcctcaccctcctcactcaggcacagggtcctgggcccagtctgccctgactcagcctgcctccgtgtctgggtcctcctggacagtcgatcaccatcctcctgcactcggaacccgcacgtgacggtttggtaggtttataacttatgtctctttggaccaacntccaccagacaaacgtaccccaaacttcatagtactttatagacggtcaacgttaaacgcccgtacgacgggtctacgttaactccgtcttcctctcggacctaccaagtccgtaggacctaaaccgccggtcctacccgtcgaaccctagtccgttacggtcgggaccttccgaggtaccgtcgaaccgggtacggacggtaccttaccgtaacttaacttttagttacggacacgtacctacaattaactacgaaacgtcgaacgtacctacgtacgtacggtttcgggttcggtacggccgggtaacgggtacccctacggttaccgccggttaactttccgggacaccggtaacccgagtcccgtacccgtaccccgtggtaacctcgttaccgtccgtacccctccttccaacttccgtactaccgtacttaccgagccgggtacgtcgtacgg

SEQ ID NO: 61613 - DNA, 744 bp, Homo sapiens
  misc_feature: GYAE6OF02JOZK3.37.14.B03.1.454.CMB.1.raw
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
tcagtagtgtagatcacgaccggtgctcgatttagtgtgagtagttccggggtacggtttggcctgggctctgctcgctcctcaccctcctcacgtccagggcacgaggtcctgggcccagtctgccctgactcacgcctgccgtccgtgtcctgggtctcgtggactgtcgatcaccncgtctcgtgcaccgnggaaccctnaggtcgtacggttgggttaggtaacttaacgngttcgtacgtcgttacgggaccaacactccaccaggtaccaaacgttacccctaaatcgtactagtaatttagacgtacgtaccgaaccgtacgtccgtgtagggttctacgtactcggtaacttcgtcgcgtacgtacgacggttcgtaacggtcaaaccgtccggtccgtacctaggaacctcgtctcggtcggcctacggtagagtccggaactcggcaccttanaacttacgttanccgaagtaccgtctaacgtaacgtacgtaaacgaacgtacacgtaaacggttctaccgttaacggttcggtttacggtaccgggtaacggtacccggtaaccgtacggtaaccgtaccgttacggttccggaaagttcccgggaaccgtaacgtcccgtaccgtaccccgtaggttaccctacgtttaccgttcccgtaccccgttaccggttcctaaacccggtctaaccctaacgtccggtcgtaccggccgttaccgtcgaaccgg

SEQ ID NO: 61614 - DNA, 694 bp, Homo sapiens
  misc_feature: GYAE6OF02I9W3R.37.14.B03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
tcagtagtgtagatcacgaccggtgctcgatttagtgtgagtagttccggcgggggggggtctcaggaggcagcgctctcaggacatctccaccatggcctgggctctgctgctcctcaccctcctcactcagggcacagggtcctggacccagtctcgccctgactcagcctgcctcgtgtcgtgggtcctccgtgacagtcgatcaccatctcctncacgtcggaacccgnagtgacgttggtagttataactatgtcttcgttggtaccaactctcgacccagacaaagtcgaccctaatcagtagtatttacgngagttacaacgtaaaccggccctaggtacgggttctactaacgtccgtctttcgcgttcgaccttaccgtaagttccgtaggaccaaacgtcccggtccccttaccgtcggtaaccctacttccgtaccggttacggtacccttacccggacggtacgtaccgggtaaccggaaccgggaaccggtacccttaccgtaactttaacgttttacgttacgaccgtacgtccttaaccgtattaaaccacgtaaacgcctaacgctacgtacgtacggtttcgggtcgggtacgtacggggaccggaccgtaccgtacgtaccggttcgttacggcgtaccgaaccggtaccggtaccgtcccggaccccgttaccgg

SEQ ID NO: 61615 - DNA, 700 bp, Homo sapiens
  misc_feature: GYAE6OF02JE8FB.37.14.B03.1.454.CMB.1.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
tcagtagtgtagatcacgaccggtgctcgatttagtgtgagtagttccgcgggggggggtcgtcgaggaggcagcgctctcaggacatctccaccatggcctgggctctgctgctcctcaccctcctcactcagggcacgagggtcctgggccccaggtctgccctgactcacgcctagcctccgtgtcctgggtcctccgtggtacagtccgatcaccatctcctgcactggaaccgnagtgacgttgngtatactatgtntctagtaccacacttcaccctagggccaaaagtccccctaaaactctactacgttagtttacgacggtaacgtaactaacccggtaaacggtccccgtaggtaaccggggttacctaacggttaaccgtcgttaccttaccgttctcggtacctaccgtaagtcctacggaccaccgaacccgtcctacccggtacacctctacgtacgtcgtcctccggacgtgaccgtacgacggtacnccgtactnttaacttcggtancgtacctagtactaactaatccggaactaggcctacggtcgttacggggttaggttccggtaggtaccggggaacgaccgttaccggaaacgggttccccgtttaaggtacccggttaaccgcgggttaaacccgacggttaccctcccgggtaacccggtccgaaccgtttcccg

SEQ ID NO: 61616 - DNA, 768 bp, Homo sapiens
  misc_feature: GYAE6OF02HCZH8.37.14.B03.1.454.CMB.1.raw
  modified_base (227)..(227): a, c, t, g, unknown or other
  misc_feature (227)..(227): n is a, c, g, or t
  modified_base (478)..(478): a, c, t, g, unknown or other
  misc_feature (478)..(478): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacaggtcctgggcccagtctgccctgactcagcctgcctcgtgtctgggtctcgtgacagtcgatcaccatctcctgcacgtacggaacccnagttgtacggttggtcgttaataacttatcgttctcttacggtaaccaacactccaaccacggaacaacgtaccccaaacgtcatagtaatttagtacggtaacggttacctaaaccgtaaaccggtccccgtacggtaacggggttacctacgttaaaacgttccgtactttacctccggttacggtacttacccgtaacgttacgtacggtaaaccaacgtacccggtccctacccgtacgtaaccgtntaccgttccgtcggtacctaccgtacggtcgtacggaacgaccggtacgtaccgtactaacttaccgtttagttacgaccgtacgtacctacgtaacgtttaacgaaaccgaacggtaccaacgtaacccttattaccggtaccggtttggggttaacgggttccggggaccgggtaccggggtaacccgtaacccggtcggttaaacccggttccggttaacggttacccgacggtaacccggaccggttacccggttaccccggtcccccggttaaccggttaccccg

SEQ ID NO: 61617 - DNA, 736 bp, Homo sapiens
  misc_feature: GYAE6OF02JF15F.37.14.B03.1.454.CMB.1.raw
  modified_base (198)..(198): a, c, t, g, unknown or other
  misc_feature (198)..(198): n is a, c, g, or t
  modified_base (232)..(233): a, c, t, g, unknown or other
  misc_feature (232)..(233): n is a, c, g, or t
  modified_base (250)..(250): a, c, t, g, unknown or other
  misc_feature (250)..(250): n is a, c, g, or t
  modified_base (698)..(698): a, c, t, g, unknown or other
  misc_feature (698)..(698): n is a, c, g, or t
tcagtagtgtagatcacgaccggtgctcgatttagtgtgagtagttccgcgggggggggtctcaggaggcagcgctctcaggacatcctccaccatggcctgggctctgctgctcctcaccctcctcactcagggcacagggtcctggcccagtctcgccctgactcagcctgcctcgtgtctggtactccgtggacngtcgatcgaccatctcctgccactcggaacccgnnggtcgtacgtttgggtntttaacaacctatcgtccttctttcgggtaacctaacgacttaccgaaccccgaacgggtaacctaaaccggttacccccctaaaacgttacccgaatttaccggtaaattttaacggtacggtaagggtttaacccaaccggttaaaacccggtccccgttacgtaccggggttaccttccttaaacgtccgtcgtttacctacgtcggtacctacaaccgttcgtcggaactaacgaccggtccctacccgtcgtacctacgttctcggtcgggtcctacccgagggcctacggtacggaccgtaagggtcctaccgttacgttaacgtttacgtcggactaacgtccttacgaacttaacgtacccaaagtccgacaccgttcaccgttagttgggtcgtacgggtcggacggtacccgccgtacgtaccgttcgtacggtaacncgtaccggtaaccgtccgacccgttcccgtacctaccg

SEQ ID NO: 61618 - DNA, 513 bp, Homo sapiens
  misc_feature: GYAE6OF02HZAOV.37.14.B03.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (415)..(416): a, c, t, g, unknown or other
  misc_feature (415)..(416): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtggttaataactatgtctcttggtaccaaacatcaccaggcaaagtccccaaaactcatgatttatgaggtcactaaacgcctnagggtctctaatcgcttctctgctccaagtctggcaacacggcctcctgacaactctctgggctccaaggctgaggacgagctgattattanncttgctcatatgcaggtatcattcttatgtcttacgaagtggaccaagggtcctacgtcctaagcgacgcccgaaggacccaaaccctcgtctaccg

SEQ ID NO: 61619 - DNA, 757 bp, Homo sapiens
  misc_feature: GYAE6OF02G5ICQ.37.14.B03.1.454.CMB.1.raw
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
tcagtagtgtagatcacgaccggtgctcgatttagtgtgagtagttccggcgggggggggtcgtcgaggaggcgagcgctctcaggacatctccaccatcggcctgggctctgctgctcctcaccctcctcacgtcagggcacgtagggtccctcgggacccagtccgtcgccctagactcgacgccgtcgcctccgtgtccgtgggtcctccgtagggactaggtcgntaccaaccntctccgtagcaacgtcggaaccgntaggtcgacggttagggtacgttaattaactgttgtctacgtacgtaactaactagtccaacaataactccgaaccgacggaactaaaccgttaccccaaaancgtaaattaacctttanacggataccgaactaaccgggtacctgtaaaaggtctttaanaacgttcgcgtttctacgtcgtaccgtcaacggttcacggaacaacgggtccctccggttacccacggaacctaacgttcctaccgggtcggtccctaaacgtacccggaaggcgggtaaacccgcggtttacgcctaacctttagggttaacctgtacggaccttactaactaacggttaactaaccgaaacgtccggtacgttacgttaccggaaggttcggttaaccggttaggggcccggggttaaagaccccgggttcgaaacgggtttcccgtaacgtaacggtcgtaacggaaccgtaccgggtcctaccccgggtccgtaaccgg

SEQ ID NO: 61620 - DNA, 843 bp, Homo sapiens
  misc_feature: GYAE6OF02F4YFE.37.14.B03.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgccttccgtgtctgggtctccgtggacagtcgatccacatcctctgcactggaaccccnagtgtacggttggttaggttaanaactattcgtctcgttggtaccaactatccacccgaggacaaacgtccccaaactcatcgtatttagtgacggtacctaacgtaaaccggcccttacgacggggttaccttacttaacgtccgtccttccttcgtcgggtccttaccgtaacggttccgttacggaccgtaaacccgtacccgggtaccccttccccgtacgtaacccctacgttcccttcggtccgggtacccgttcccgaacgggtccgtaccgggtaaccggaaccgggtacgggtcccttacccgtaactttaacgttttacgttacgaccgttaacgggtaccttaactaaacggtttaaccttaaaccgaaccggtaaccgtacggtaaccttaaccgtttaccgttaaaccggggtttttccggggggtttacgggttttacccgggggaccggggtaaacccgggggaaaccccggttccggttacccgggttacccccgggtttaaaccgtttaccggggtttaacccggaaccggttaccccgggtaaccggggtaccccgtccccggggtttacccccccggtaccggtttacccccgg

SEQ ID NO: 61621 - DNA, 775 bp, Homo sapiens
  misc_feature: GYAE6OF02HJ9GR.37.14.B03.1.454.CMB.1.raw
  modified_base (229)..(229): a, c, t, g, unknown or other
  misc_feature (229)..(229): n is a, c, g, or t
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
tcagtagtgtagatcacgaccggtgctcgatttagtgtgagtagttccgcggggggggtctcaggaggcagcgctctcaggacatctccaccatggcctgggctctgctgctcctcaccctctcactcagggcacagggtcctgggcccagtctgccctgactcagcctgcctccgtgtctgggtctcgtggacagtcgatcacctatctcctgccacgtggaacccgntagtgtacgttggtaggttataactatgtctacttggtaccaacatccaccgaggacaaacgtccccaaactcatgtaatttanagtagtacaacgtaaccggcctcgacgggtctactaagtccgtcgttactcgtcgtctaccttaagcgttcgacctacgaccgtccctaccggtanaccgtacttcgtcgtcgggtacctaccgtacggtcgtacggaccgaacggaccggtactacgtaacttaacggttttaactcgtaccgtacggtacccttacgttaaacgttaacgttaaaacccgacgtaaaccgtcggtaaaccctttacgttaaacccgttacccgggttttaagggggttacccgggtttacgggggtacccggggaaaaccggggggtaccccgttaacccgggttaacccgggttaacccccggttttaacgggttaacccggttaccccggttaaaccgggacccccggtaaaaccgggtttccggtaaccccccgggtttccccccgggtaaaccggtttacccccgg

SEQ ID NO: 61622 - DNA, 599 bp, Homo sapiens
  misc_feature: GYAE6OF02FNEP8.37.14.B03.1.454.CMB.1.raw
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagtagtgtagatcacgaccggtgctcgatttagtgtgagtagttccgcgggggggggtctcaggaggcagcgctctcaggacatctccaccagtggcctgggctctgctgctcctcaccctcctcactcagggcacgagggtcctgggcccagtctgccctgactcagcctgcctccgtgtctgggtctcctggacagtcgatcaccatcctctgcctacgtacggaacccgnagtgtacggttggtggttanactatgtctcgttcgtaccacactaccacccgaggacaacgtacccaactcatntattangacgtacacgtaacgcctacgaggtctagtaactcgtacttctcgtgcctacctaagtcgtcgacaacgccggtaccctccgtacgtacctactctcggtcggccttacgacgtcagtaccgagtacgactacgtacttagtacttcgancgtactanactataacacgtcagactatcgtcggttggtcggttcgggagggtacccggtaccggtacctcggttaccgtcggttaccgtacgaccggacccgaaggtcccgcccggttacccggtgtaccccg

SEQ ID NO: 61623 - DNA, 698 bp, Homo sapiens
  misc_feature: GYAE6OF02HQJNO.37.14.B03.1.454.CMB.1.raw
  modified_base (175)..(175): a, c, t, g, unknown or other
  misc_feature (175)..(175): n is a, c, g, or t
  modified_base (189)..(189): a, c, t, g, unknown or other
  misc_feature (189)..(189): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcacatctcctncactcggaacccgnagtgacgttggtggttataactatgtctcttggtaccaacatccacccgaggacaaacgtccccaaactcatgtatttagtgagtcaactaacggccctagtagggtctactaatccgtcttctctggcctacgagtcgtacggcaaccgaccggccctccgtacgacctactccgtcgtacggcctacgacggtctaggacggtacggacggtctacgtacttatttacgtcgacgtacgtcctactaagttaactacgaagtacagactacgttcgtacggtttcgggttaggtccggggacgggaaccggaccgtccgggtaacgtcccggttacggttacggtaccgaccggaacccgtaccggtccgtacccggttccccggttaccggttacccgtaccgtttcccgttaccccgttccccctacccccgttacctacctacccgttaccgttaacctaccggtaccgtaccgggtacgggttcccggggacgttacccgggg

SEQ ID NO: 61624 - DNA, 697 bp, Homo sapiens
  misc_feature: GYAE6OF02HD0BG.37.14.B03.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
  modified_base (281)..(281): a, c, t, g, unknown or other
  misc_feature (281)..(281): n is a, c, g, or t
  modified_base (458)..(458): a, c, t, g, unknown or other
  misc_feature (458)..(458): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcacgtcggaacccgnaggtgacgttggtggttataactatgtctcttaggtaccaanactccacccaggaccaaacgtaccccaaacgtcaagtgtacttttagngtacggtacaacgtaaaccggcctacgtacggggtcttacctaagttcgcttactctggcctacacgttcgtggacacgaccgtcccttccgacgtaccatcgtactcggggcctcgacggtactaggaccggacggtcggaccttacgtaacttacgttatcgcagtccttactanaacgttaagaacgcgagtactagtacgtacgtttcgggtacggtttaccggcggggaaccgggtaccgtaccgtacggttacccgttacggttaaggccgtaacggacccgaacgggttcgtaacccccggtccgttaccggtaccttacccgtcctacccgggttcccctaacccgttcccttaacgtaccttacccgtacgtacctacggtacgaccgggtaccggtagtaaccggg

SEQ ID NO: 61625 - DNA, 581 bp, Homo sapiens
  misc_feature: GYAE6OF02JFBHR.37.14.B03.1.454.CMB.1.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatccaccatctcctgcactggaacccncagtgacgttggtggttaataactntgtctcgttggtaccaacatcaccnggcaacgtcccaaatcatgattatgagcactaacgcctnagggtctanatcgctcnctgctctagtctggcaacacgcctaccngaccatcctcgtcggtctccgagtcgtgacgtacgaaggtctacacgtattagtncagcacgtaanacgtacaagtcacgatacgtctacgttgggttcgttcggggacggtacgggaccggactcggtaaccgtcgttaaggtcctaacgacccgaaggtccgtcccggcccgtcgggtcctacgtccttccggtccccgttccctacctcgtaaccttaccgtaccaccgttcgaacgtcggaccggtcgtaccgg

SEQ ID NO: 61626 - DNA, 756 bp, Homo sapiens
  misc_feature: GYAE6OF02ILT3S.37.14.B03.1.454.CMB.1.raw
  modified_base (204)..(204): a, c, t, g, unknown or other
  misc_feature (204)..(204): n is a, c, g, or t
tcagtagtgtagatcacgaccggtgctcgatttagtgtgagtagttccggggactttgcctgggctctgctgctcctcaccctcctcactcgagggcacagggtcctgggcccagtctgccctgactcagcctgcctccgttgtcgtcgggtctccgtggactagtcgatcacctactcctcctgacctacgtcggaaacccgngtaggtcgtaacggtttgggtacggtttaataaacgttgtcgttcttacgttacggtaaccaactactaccgaaccgtaagggtaacctaaaaccgtacccaaacgtctaagttacgtagtttggagaacggactaaggtaacgccgtaccgtacggttagggtttactaacggtcgtccttcgtcgtcggtctacgtagtcgtacgaccgaacgaccggtcctcgtacgaacctctcgtcgtcgactacgcggactacggacgacggagaccttacgtaacttagttacgtcgactagcgtataaactaacgacgaagtaccacggtactacgtcgttacgggttcgggtacgggtacggacggtaccggtacctaccggtacgtaccgttacgttacgtaccgtaaccgtaccggtacgtacccgtccgtaccccggttcgttaccccgtactttacccggttcccgtccccggttaccttaccgtacgtacctttaacggacctttacccggaccgggttacggcccgggttaccggtaccggtaacgg

SEQ ID NO: 61627 - DNA, 652 bp, Homo sapiens
  misc_feature: GYAE6OF02GUOHE.37.14.B03.1.454.CMB.1.raw
  modified_base (224)..(224): a, c, t, g, unknown or other
  misc_feature (224)..(224): n is a, c, g, or t
tcagtagtgtagatcacgaccggtgctcgatttagtgtgagtagttccgcggggggtctcaggaggcagcgctcctcaggacatctccaccatggcctgggctctgctgctcctcgaccctctcactcagggcacagggtcctgggcccagtctgccctgactcagcctgcctccgtgtctgggtctcctggacagtcgatcaccatctctgcactggaacccnagtcgacggttggtgttataactatgtctcttgtaccaacatcacccaggcaaacgtaccccaaactcaatcgtatttagtagacggtacaacgtaaaccggccgtacgaggggttcctacttaacgtcgtcttctcgtcggcctccgaagttctacgggacctaacgacccggtccctacccgtacggtaccctattccgtcggtcgggtacctccggtacggtaccttacggaccggtaacggaacggtcctcgtaaaccttacgttagttcgactacgtctaacgtataataaccgaagctagtactactaccgtacggtttggtcggtacgggtacgggacgggtacccgtccgtaccggtaccgttacgttacggtaccgtaccgtaccggtaagtcccgtaccgtccccggttacgtacccg

SEQ ID NO: 61628 - DNA, 1095 bp, Homo sapiens
  misc_feature: GYAE6OF02FLM1H.37.14.B03.1.454.CMB.1.raw
  modified_base (132)..(132): a, c, t, g, unknown or other
  misc_feature (132)..(132): n is a, c, g, or t
  modified_base (154)..(154): a, c, t, g, unknown or other
  misc_feature (154)..(154): n is a, c, g, or t
  modified_base (159)..(159): a, c, t, g, unknown or other
  misc_feature (159)..(159): n is a, c, g, or t
tcagtagtgtagatcacgaccggtgctcgatttagtgtgagtagttccgcgggggggggtctcaggaggcagcgctctcaggacatctccaccatggcctgggctctgctgctcctcaccccctctcacagnggcacggcggtcgcggctgtcncgccngctcgcgcgtcgccgtcgtcgtcgtcggtcctcgtaggacgtcgtacgtactaccactacgttcccgttccgtacgtaccgtaccggtaaccccgggaaccccgtacgtacgggttaccggttacggggttttaggggtttaacgtttaaaaccgttaacgtttacggttccggtttcccgtttaccgggttttaaccggtaaaaccctaaaaccttaccgttaaccccccgaaacccgggaacggtaaaaccccgttaaaaccccccggtaaaaccccccttaaaacttaccgtaaggttaacgttttaaaacgtttttagggtaaccgggttaaccggttaaaacccgttaaaaaccgggttaaaaccccccggttcccgttaacggggggttacccgggtttaccccttttaaaacgttaaccggttcccgtttccgtttcccgttaacgggttccggttacccttaaaacccggtacgtttcccggttaaccggaaacccgttaaaccccgggccccgggttacccccttaaccgggttaccaaaccgtttcgttcccgttcgggtacgtccccgttaacgggccggtaccggttaaccggaaaccggtaccgggaccgttccctaaaccgttaaacgtttaacgtttacccggttacgaaccggttaccgtaccttaattaaaccgttaaccgtaaaccgaacgtaccggttaccgaacgtttaccttaccggtttaaccggggtttgggtttcccggggtttacgggggaacccggggttaacccggggtaacccttaacccgggggttacccggttaaacccccgggttttagggtttaacccccggaaccgggttaccccggtaacccggggtaaccggtttacccccggtaccccccgggtttccccggttacccggttaacccccg

SEQ ID NO: 61629 - DNA, 900 bp, Homo sapiens
  misc_feature: GYAE6OF02GMIHZ.37.14.B03.1.454.CMB.1.raw
  modified_base (627)..(627): a, c, t, g, unknown or other
  misc_feature (627)..(627): n is a, c, g, or t
  modified_base (888)..(888): a, c, t, g, unknown or other
  misc_feature (888)..(888): n is a, c, g, or t
tcagtagtgtagatcacgaccggtgctcgatttagtgtgagtagttccggggactttgcctgggctctgctgctcctcaccctctcactcagggcacgagggtcctgggcccagtctgccctgactcagcctgccttccggtgtcgttcggggtcctccgtgggaccaggttacgattaccacctatccgttcctcggacctaccgtaccgggaacccgtcgaggttcggtaacggtttggggttaaggttaaacttaaaccgttagttcggttcctttacggttaccggtaaaccaacctaacgtacccgaccggtaaacggaccgtaaaaccgtaccccctaaaaactcggtaacgtttacggtatttaacgtgggtaacgtacccgtaacggtaaacccggccgttacgggtacggggttaccttacggtacttacccggttctttaccgcggttaccggtaccttacgtacggtaccggtacgtaacccacggtacccgtcccgttacccgacgtaccttacgtccgtcggaccggttcgacggtacggtaccggtaggacggtcggtaaaccgtccgttactaagtttcggttataccggtaactcgtctaaatacgttaanaaccgtagtaccgtagtacctacggttacttacgggttaacggggttcacggggttccgggaaccgggtaccgtaaccggtccggttaacgttaaccggttaccggaccggttaacccgtaccgggtaaccgtcccggttacccgtcccgggttaccgtcgttacccttcccgttaaccccggtttacccgtaccgttaccctacgttaccccgtttaaacgttcccgaaccggtttaccggacgggacccgggttaccgnggttaacccggg

SEQ ID NO: 61630 - DNA, 611 bp, Homo sapiens
  misc_feature: GYAE6OF02HOA5G.37.14.B03.1.454.CMB.1.raw
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaaccaacatcacccgaggaccaaacgtcccaaactcatgatttatgaggtcaactaaacggccctgagggtctctaatcgcttctctggctaccagtcnggacaaccncggcctcctgaccnttcnctggctcgngctgacgacgagctnacttattnttgcaagtctacaagtacagtaagacaacgcacttcgtaacggtttgggttacgtttcgggacgggtaacgggtacccgaccgtcgtaacccgttcgttaacggtaccacgacccgtaaggtcctaccgtccccgtacgtcccgtaccttccctttccggtaaccccgtccctaccgttcctaccgttacctaccctacgtacctcgggaaccgtcgggtacgtacgggg

SEQ ID NO: 61631 - DNA, 697 bp, Homo sapiens
  misc_feature: GYAE6OF02FLM85.37.14.B03.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (578)..(578): a, c, t, g, unknown or other
  misc_feature (578)..(578): n is a, c, g, or t
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacgagggtcctgggccagtctgccctgactcagcctgccctcgtgtcgtgggtcctcctggaccagtcgatccacctatccgttcngaccactaccggacccngagttcgacgggttgggttagttaactaacgtgttcgtcgttacgttacgtaaccaactacttaccgaccgtaaggacaaaccgttccccaattcgattacttagtttacgtagtacgggtacaaccggtaaccggtcccgtaggtacggttcttaacgtactcgtcttaccgtgtccgtctaccgtaacggtttccgagggtaaccaccgtaccggtcccctaccggtacaacctatccgtacgtccggtcctaccgagtccacggtaccggacgacggttcctaccgtaactttattatcggacgtacgtctaacgtattacgaacgacacgaactntactacgtacgggttagtccgggtacgggccggaacgggtaccctcgggtaccgtaccgggtttactacggaccgtaaccgtaccgaccggttcctccccggttacctcccggttaccg

SEQ ID NO: 61632 - DNA, 642 bp, Homo sapiens
  misc_feature: GYAE6OF02IJGYR.37.14.B03.1.454.CMB.1.raw
  modified_base (280)..(280): a, c, t, g, unknown or other
  misc_feature (280)..(280): n is a, c, g, or t
  modified_base (484)..(484): a, c, t, g, unknown or other
  misc_feature (484)..(484): n is a, c, g, or t
  modified_base (570)..(570): a, c, t, g, unknown or other
  misc_feature (570)..(570): n is a, c, g, or t
  modified_base (637)..(637): a, c, t, g, unknown or other
  misc_feature (637)..(637): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtcgtgggtctcctggacagtcgatcaccatcctcctgcacgtcggaaccgcagtgtacggttgggtagttaataactatcgtctcgttcgtaaccaatctcacccgaaggaccaaaccgtacccaaactcatgtattanggagtactaacgtaaaccggcctacgacgggtcctactaacgtcgtcttctcgtcggtcctacgtaacgtcgtacggacaaccgtaccgtccctccgtacgaacctacgttccgtacggtcgggtacctaccgacggtcgtacggacggtaacggtacggtctacctatttactagtcgcaacgtctaacaattaacaacgtanactagactatacgtcgttgggtcgtacgggacggtacggacgtaccgtacgtaccgtacgttacggacaccgacgtacgccgtccncccgtcgcctacgttcgttcccgtccctccctctacctacttctacgtctacgacgggtcgccggtnaccgg

SEQ ID NO: 61633 - DNA, 670 bp, Homo sapiens
  misc_feature: GYAE6OF02GFQN1.37.14.B03.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (312)..(312): a, c, t, g, unknown or other
  misc_feature (312)..(312): n is a, c, g, or t
  modified_base (524)..(524): a, c, t, g, unknown or other
  misc_feature (524)..(524): n is a, c, g, or t
tcagtagtgtagatcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacngtcgatcacatctcctgcacgtcggaacccgnagtgacgttggtagttaataaatntgtctgttgtaaccaacnctacaccaacgatcaacccagacaaacgtccccaaactanaattatttatggaacgtacaacgtaacggccctagagggtctactatacgtcttactcgtgactcgaagtcgttcggactaaccgacggcccgttcctacgacccagtcctgtcggtacctaccgacgtagacgggacgtaggccttaaccgatttaacttagttgacctagtacctctaaattaagtaaccgtaaacgtcgaaccgggttntacccgtaagggttttacggggggttacttaccccgggggaagggacccggggtaaccccgtaccggtttaccggaacccgttttagttaccggtaactaccgggtaccgaaacgggttccttaccccggggacccctttaccggg

SEQ ID NO: 61634 - DNA, 703 bp, Homo sapiens
  misc_feature: GYAE6OF02JN80A.37.14.B03.1.454.CMB.1.raw
  modified_base (237)..(237): a, c, t, g, unknown or other
  misc_feature (237)..(237): n is a, c, g, or t
  modified_base (438)..(438): a, c, t, g, unknown or other
  misc_feature (438)..(438): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcaccatctcctgcactcgggaacccgcagtgacggttgggtggttaataactatgtctcttacggtaccaacntaccaaccagaacaaacgtccccaaactcatgtattatgagtacactaaccggcctcgacggggtctctaatcgtcttctcgtcggctacctagtctaggacctaacgaccggtacccttccgtcgacctatccgtacgtcgggactaccgcggtacgtacgaccggacggacgtccgtactaacttatttacgttcgacncgtactacctataacgtacaacgtnaacncgtactacgtaggttgggttcgttacggggaccggtaacgggacccgaccgttacggtaacccggttcgttaccggtacgtaccggaccgtaccgggttccgtcccggtaccccgttacggttaaccctcccggttttacccggccccttccccggtacccttacctaaccgttacctaaccgtaccgtttacccggaacggtttccgggaccgggttccggtaccgggtaaccgg

SEQ ID NO: 61635 - DNA, 954 bp, Homo sapiens
  misc_feature: GYAE6OF02GDR1K.37.14.B03.1.454.CMB.1.raw
  modified_base (191)..(191): a, c, t, g, unknown or other
  misc_feature (191)..(191): n is a, c, g, or t
tcagtagtgtagatcacgaccggtgctcgatttagtgtgagtagttccggggactttgcctgggctctgctgctcctcaccctcctcactcagggcacagggtcctgggcccagtctgccctgactcagcctgcctccgtgtctgggtctcctggacagtcgatcacctatctcctgcacgtggaacccgnagtgtacggttggtaggttaataactatgtcttcgttcggtaaccaactatccaacccgaaggaccaaaacgtaccccaaaactccaagtacgtaatttaataggaacggtaccaaaccgtaaaccggtacccctacggtaaggggttcttacctaaacgtccgtctttctacgttcggaccttaccgaagttccgtacgggaccaaaccgtaaccggtcccttacccgtacggtaaccctaacttccgtcgtacgggtaccctaaccctaaacgtacgggaaggacggtaacggtacctacgtaaactttaatttacttcgggaactacgtacgtaacctaaattaaacgttaaaccgaaacgtacgtaacgtccgttaacgttacgggtttacggggttacgggtttaccgggaaccggggtaaccggggtaaacccgttaccggttaccgggtttaacccgggttacgttttaaaccggggtaccgtaaaccccgggtaaccccgttaaacggggtaccccgtttaccccggggtaccccccccgtttacggggttaacccgttacccccggtttaaccccggttttcccccgggtttacccccccggttacccccgtttaaccccggtttaccccgtttaaaaccccgtttcccccgttaaaacccgtttaacccgttaaaccgggtttcccggggtaaacccgggtccccggggggttacccgtttaaacccgggggaaccccggttaaacccggggg

SEQ ID NO: 61636 - DNA, 698 bp, Homo sapiens
  misc_feature: GYAE6OF02GZ2WK.37.14.B03.1.454.CMB.1.raw
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
tcagtagtgtagatcacgaccggtgctcgatttagtgtgagtagttccggggactttgcctgggctctgctgctcctcaccctcctcactcagggcacgagggtcctgggcccagtctcgccctgactcacgcctgcctccgtgtcgtgggtctcctggacagtcgatcaccatcctcctgacctagtacggaacccgcaggtcgtacggttggtagttaataactagttgtctcgttagtaccaactatccgaccgaggaccaaacgtacccaaatcatntacgttangacgtacaacgaaccgtcctagtacggtctactaatccgtcttctcgtagcctacgtagtcgacgacaacgccggtccctacccgtagaaccatcggtcgtggcctacgacggtctacggaacggcgaacggtcctaacagtttagtcgtaaagtcgaccgtactacaaacttaacgaacgaacgtaacaacgtacgtaaccttacggtacgttcggggtacggtttacgggaccggggtaaccggtaccgtaccggtcctaagggttcccggtaaggaccgtaccggaccgttacgggcccgtaacccggtcccgttacgcctacgttacccttcccggacccccttactaccctacgtaaccctaagttaacctacgttaccggaggtaccggcggtacgtaccggg

SEQ ID NO: 61637 - DNA, 877 bp, Homo sapiens
  misc_feature: GYAE6OF02HVA80.37.14.B03.1.454.CMB.1.raw
  modified_base (138)..(138): a, c, t, g, unknown or other
  misc_feature (138)..(138): n is a, c, g, or t
  modified_base (154)..(154): a, c, t, g, unknown or other
  misc_feature (154)..(154): n is a, c, g, or t
  modified_base (166)..(166): a, c, t, g, unknown or other
  misc_feature (166)..(166): n is a, c, g, or t
tcagtagtgtagatcacgaccggtgctcgatttagtgtgagtagttccgggactttgcctgggctctgctgctcctcaccctcctcactcagggcacgagggtcctggcccagtctgccctgactcagctgcctcgtntcgtggtctctggacngtacgatcaccntctcctgcactcggacccgctagtgacggtttggtacggttactaacgttagttcgttccttgttacggtaacccaactacgttaccccaaccgaggtaccctaaaacggtaccccctaaaactccgtaatacggtaaactttttacgtaggtaaccgggttaccttaaaccggtaaaccggcccccgttacggaacggggtttaccgttacgttaaaccggttcctaccgttttccgttaccgttcgggtaccgttacccggtaaagttccgtacggtaacccgaccgtaacccggtcccttaccccgtcgtaccgtacttccgtcggtccgacgtcccgacggtacgtcgaaccggtacgtacgggtcctacttaccgtactttacgttacgccgttacgtaccgtactaacgttaaacgtaaacgtacggtactaacgacgtaccgttaacggtttcggttacggggtttacggttcggggacccgggtaaccggtacccggtaacccgggttacgttacccgttacgtaaccggttaccaaccgggttaacccggacgttacccggtcccggtaccccgttaccggtaccctttacccggtcccgtttccccggtacccccgtacccggttccctacccgtaacgtttccccgttaaccgtccggttaacccggtaccgggtcggttcccgggtactaacccggggg

SEQ ID NO: 61638 - DNA, 662 bp, Homo sapiens
  misc_feature: GYAE6OF02JL69B.37.14.B03.1.454.CMB.1.raw
  modified_base (182)..(182): a, c, t, g, unknown or other
  misc_feature (182)..(182): n is a, c, g, or t
  modified_base (201)..(201): a, c, t, g, unknown or other
  misc_feature (201)..(201): n is a, c, g, or t
  modified_base (206)..(207): a, c, t, g, unknown or other
  misc_feature (206)..(207): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (505)..(505): a, c, t, g, unknown or other
  misc_feature (505)..(505): n is a, c, g, or t
tcagtagtgtagatcacgaccggtgctcgatttagtgtgagtagttccgcggggggggggtctcaggaggcagcgctctcaggacatctccaccatggcctgggctctgctgctacctcaccctctcactcagggcacgaggtcctgggacccagtctcgccctgactcagcctggcctcgngtcgtggtcctcgtgaccnggtcnnccacntccncgtncctacgtcggaaccnagtgtcgttggtagttanactntnctctgacanatcacagacaactcccgaatcatactattnacgtacgtacaacgtacggacctcggtagtccgttactacncgttctactcgtacgcttcgtaacgtcgacggtaccaacgaccgttcctccgtacgtacctaactccgtacggtcggtaccctacgacggtcgttccggaacgggacgtaccggttactaccgttaacgttaacgttaccgtccggtaagccgttctaacggttanaaccgttaaacgcgtaacgacgaccgttagtcccgttaaggttcgggtaccgggtaccgggcggtaaaccgggtcccgtaacgttcgtaaacggttccgttacgggtacccacggtacccggacgtcccggttacccgtacccgttcgttaacccgg

SEQ ID NO: 61639 - DNA, 713 bp, Homo sapiens
  misc_feature: GYAE6OF02J0VGC.37.14.B03.1.454.CMB.1.raw
  modified_base (190)..(190): a, c, t, g, unknown or other
  misc_feature (190)..(190): n is a, c, g, or t
tcagtagtgtagatcacgaccggtgctcgatttagtgtgagtagttccggggactttgcctgggctctgctgctcctcactctcctcactcaggacacgagggtcctgggcccagtctcgccctgactacagcctgccctcgtgtcgtcgggtctccgtaggacagtcgactccacatcctcctgcacgngaaccagcagtgattattagtaaaccttataaccgtttgttccgttacgttacggtaaccaacgacgacccgaaccgaacgggaccaaacccgcccccaaaacgtctaattggtacgtttggaggaacgtacgacggtaacggccgtcctacggtacggttactagtcgtccttcgtcgtcggcctacgtacgtcgtacgacctaaccgaccgtcctaccagtacctcgtcgcgtcgctccggagtcgaggacgagtcgacgtataacgtttacgttacgtacgtccgtacgtctagtacgttcgacgtacgtacgttactccgttacgtttacttacgttcggttaaccgtacgtaacggtaccgggtaacgtaccgtaccggttacgtaccgtacgacgacccgtaccgtaacccgacctacccgtcgtaccgttcctaaccgttccgtacccgttcccgtaccccgttaccttaccgtccttaaccgaaccgttaacgtccggtaggtacccggtacggg

SEQ ID NO: 61640 - DNA, 697 bp, Homo sapiens
  misc_feature: GYAE6OF02H76QA.37.14.B03.1.454.CMB.1.raw
  modified_base (241)..(241): a, c, t, g, unknown or other
  misc_feature (241)..(241): n is a, c, g, or t
tcagtagtgtagatcacgaccggtgctcgatttagtgtgagtagttccggcggggggggggtctcaggaggcagcgctctcaggacatctccaccatggcctgggctctgctgctcctcaccctcctcactcgagggcacgagggtcctgggcccagtctgccctgactcagtcctgcctcgtgtcgtgggtctccgtggacagtcgatccacctatcgtcctgcctacgcgggaacccgnaggtgtacggttggtagttaagtactattcgtcttcgttacggtaaccaacgtctaccgaaccgacgacctaaaccgtaaccccaaactctagttacgttatttacgaggtacgtacctaacggtaaaccgtccgttacggacgggttactacgtaactcgtcttccgtcgtcgtctacgtacgtcgcgaccacgtaccgcccgtcctacgtactacgtcgttcggcgtccgtacgtcggctacggaacgacggtacggtctacgtaacgttacttcgtcgactacgctaactacgtaactacggtagaccgtacgtccgttaacgttcggtgggttaccgggtcgggtacgggacggttacccggtacggttccggtaaccggtttcggtaacggtccgaaccggtaccggtacggtacccgttcccggaaccccgtttacggtccttaccccgg

SEQ ID NO: 61641 - DNA, 860 bp, Homo sapiens
  misc_feature: GYAE6OF02FGZGK.37.14.B03.1.454.CMB.1.raw
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (491)..(491): a, c, t, g, unknown or other
  misc_feature (491)..(491): n is a, c, g, or t
tcagtagtgtagatcacgaccggtgctcgatttagtgtgagtagttccggcgggggggggtctcaggaggcagcgctctcaggacatctccaccatggcctgggctctgctgctcctcaccctcctcactcagggcacgagggtcctgggcccagtctgcctgactcagcctgcctccgtgtcgtgggtcctccgtaggacagtcgactcaccntcctctgctacgtcggaacccnacgtgtcggttggtcgttaactacgtatcgtaccttcgttacggtaaccacgtactccaaccgaggacctaaaccgtcccctaactacatacgtactttaagcggtacgtactaaccgtaaacccggtcccgttaggtaacgggtttactaacgtcgtccgtttactcgtcgtacctccgtaacgttcgacgtaaccaacgtcccggtaccctacccgtacgaccttaacgtcctacggtacgggtcctaccggnggtaccgtaggaacggaccggtacgtacgtacgtaaacgtttacgttaccgtcgggttacttaccgggtacttaccgtaacgttaaccgggttacgtaacccgggttaaacggtttaacccggtttaacccttaacggtttttaaccgttaaccgttttacccggggttttaacccgggttaaaacccggggttaacccgggttaacccggggggtaaaaacccgttaacccggggttaaccccgttaaccccggtaaacccggttaaaccggtttaccccggaaacccgggtaaccccccggtaaaccccgtaaaccccccggtaaccccgtacccggtttaacccggttacccctttaacccccggg

SEQ ID NO: 61642 - DNA, 434 bp, Homo sapiens
  misc_feature: GYAE6OF01EDNX3.37.62.F07.1.454.CMB.1.raw
  modified_base (432)..(434): a, c, t, g, unknown or other
  misc_feature (432)..(434): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 61643 - DNA, 436 bp, Homo sapiens
  misc_feature: GYAE6OF01BNLZM.37.62.F07.1.454.CMB.1.raw
  modified_base (431)..(436): a, c, t, g, unknown or other
  misc_feature (431)..(436): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnn

SEQ ID NO: 61644 - DNA, 518 bp, Homo sapiens
  misc_feature: GYAE6OF01BWPNV.37.62.F07.1.454.CMB.1.raw
  modified_base (484)..(485): a, c, t, g, unknown or other
  misc_feature (484)..(485): n is a, c, g, or t
  modified_base (488)..(507): a, c, t, g, unknown or other
  misc_feature (488)..(507): n is a, c, g, or t
  modified_base (509)..(510): a, c, t, g, unknown or other
  misc_feature (509)..(510): n is a, c, g, or t
  modified_base (512)..(518): a, c, t, g, unknown or other
  misc_feature (512)..(518): n is a, c, g, or t
tcagtagtgtagatcacgaccggtgctcgatttagtagtcgcataaagggaaagggactggaagggtggggtactcaggtacttggtggcgagtggtgagaccacgatactacgcgacgactccgtgaagggcccggttcgaccatctcccagagacaagtttcccaaggaacacccctggtctctgcaaactgaacaacctcgagacgcccgaggaccaccggccctatattactgtacgaaaatgggcctacggatatgactatattgggactgggtacttcgatcgtcttggggcccgtaggcacccttgggtcctacgttgtctcctcacgccctccgaaccgaaccgggacccatccggtcttccccctggcgtccctgctccaggactcacctaccggagacgcacagcgccctgggctggcctggtcaaggactacttccatctacactactgagcgggctggcaaggcgcatagtnnatnnnnnnnnnnnnnnnnnnnnannannnnnnn

SEQ ID NO: 61645 - DNA, 438 bp, Homo sapiens
  misc_feature: GYAE6OF01DM8UZ.37.62.F07.1.454.CMB.1.raw
  modified_base (362)..(362): a, c, t, g, unknown or other
  misc_feature (362)..(362): n is a, c, g, or t
  modified_base (432)..(438): a, c, t, g, unknown or other
  misc_feature (432)..(438): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacngcggccctgggctgcctggtcaaggactacttccatctacactactgagcgggctggcaaggcgcatagnnnnnnn

SEQ ID NO: 61646 - DNA, 435 bp, Homo sapiens
  misc_feature: GYAE6OF01D0XA1.37.62.F07.1.454.CMB.1.raw
  modified_base (432)..(435): a, c, t, g, unknown or other
  misc_feature (432)..(435): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnn

SEQ ID NO: 61647 - DNA, 444 bp, Homo sapiens
  misc_feature: GYAE6OF01BATHZ.37.62.F07.1.454.CMB.1.raw
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (419)..(444): a, c, t, g, unknown or other
  misc_feature (419)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccccgaggacacggccctatattactgtgcgagagatcagacggagtatagcagcagctctgactactggggccacggaaccctggtcaccgtctcctcacgcctccaccaagggcccatcggtccttccccnggccaccctcctccaaagcgccactcgnggggcacngcggcctggctgcctggtcaaggctactcatctacnctactgacgcggctggcaagcgcatgnnnnnnnnnnnnnnnnnnnnnnnnnn

SEQ ID NO: 61648 - DNA, 449 bp, Homo sapiens
  misc_feature: GYAE6OF01E0JGH.37.62.F07.1.454.CMB.1.raw
  modified_base (442)..(449): a, c, t, g, unknown or other
  misc_feature (442)..(449): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccagtccggtccttcccccgtggccgccctgcctccaggacgccacctccgagagcacgagccggccctgggctgcctggtcaaggctacttccatctacactactgagcggctggacaaggcgcatagnnnnnnnn

SEQ ID NO: 61649 - DNA, 452 bp, Homo sapiens
  misc_feature: GYAE6OF01DVC65.37.62.F07.1.454.CMB.1.raw
  modified_base (333)..(333): a, c, t, g, unknown or other
  misc_feature (333)..(333): n is a, c, g, or t
  modified_base (430)..(452): a, c, t, g, unknown or other
  misc_feature (430)..(452): n is a, c, g, or t
tcagtagtgtagatcacgaccggtgctcgatttagtagtcgcataaagggaaagggactaggagtgggtctcgaggtattggtggcagtggtgagaccacatactacgcagactccgtgaagggccggttcaccatctccagagacaattccaagaacaccctgtctctgcaaatgaacaacctgagagccgaggacacggccctatattacgtgtacgaaaatggcctacggatatgactactattgggactggtacttcgatctctggggccgtggcaccctggtcactgtctcctcagcctcaccaagggcccatcggtctcccctggcncctgctccagagcacctcgagagcacagcggccctgggctgcctggtcaaggactacttccatctacactactgagcggctggcaaggcgacatagnnnnnnnnnnnnnnnnnnnnnnn

SEQ ID NO: 61650 - DNA, 438 bp, Homo sapiens
  misc_feature: GYAE6OF01BL034.37.62.F07.1.454.CMB.1.raw
  modified_base (433)..(438): a, c, t, g, unknown or other
  misc_feature (433)..(438): n is a, c, g, or t
tcagtagtgtagatcacgaccggtgctcgatttagtagtcgcataaagggaaagggactggagtgggtctcaggtattggtggcagtggtgagacaacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctcggcaccctcctccaagagcacctctgggggcacagcggccctgggctcgcctggtcaggactacttccatctacactactgagcgggctggcaaggcgcatagnnnnnn

SEQ ID NO: 61651 - DNA, 440 bp, Homo sapiens
  misc_feature: GYAE6OF01B15E2.37.62.F07.1.454.CMB.1.raw
  modified_base (434)..(440): a, c, t, g, unknown or other
  misc_feature (434)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaaggactacttccatctacactactgagcggctggcaaggcgcatagnnnnnnn

SEQ ID NO: 61652 - DNA, 603 bp, Homo sapiens
  misc_feature: GYAE6OF01E3JR8.37.62.F07.1.454.CMB.1.raw
  modified_base (527)..(527): a, c, t, g, unknown or other
  misc_feature (527)..(527): n is a, c, g, or t
  modified_base (541)..(541): a, c, t, g, unknown or other
  misc_feature (541)..(541): n is a, c, g, or t
  modified_base (560)..(560): a, c, t, g, unknown or other
  misc_feature (560)..(560): n is a, c, g, or t
tcagtagtgtagatcacgaccggtgctcgatttagtagtcgcataaagggtaaggggtacgggtggaagtgggtctcaggtattggtggcgacgtggtggaacgaccacgaacctactacgcagacttccgtgtaacggcccggttcaccatctccgagacgacaaacttcccgaagaacacccttgtcttctagcaaattgaaccaaccgtgacgagcccgtaggacaccggcccggtatattactcgtaccgaaaatcggcctacggggactatgaacttactactgggactggtacttccgagtcctctggggccgtacggtcgacccctagggtccaccctagtcctcccttccagcccctccaccaagggccctatcggcgttccccctgggccgcccttcgctccaggtacgcgaccgtccgagaggccacgacgcggccccttgggcctgccctcggtcaaggactacttccactcgtacacctactagagttcgggctaggcaaggtcgcgataggcanatgctcaccccgancactcgcacgacgacgacncgcagagacgaacgacgtgtcgtcgtcgacacactctgtcgtc

SEQ ID NO: 61653 - DNA, 434 bp, Homo sapiens
  misc_feature: GYAE6OF01ESHZQ.37.62.F07.1.454.CMB.1.raw
  modified_base (431)..(434): a, c, t, g, unknown or other
  misc_feature (431)..(434): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaggactacttccatctacactactgagcgggctggcaaggcgcatagnnnn

SEQ ID NO: 61654 - DNA, 441 bp, Homo sapiens
  misc_feature: GYAE6OF01DAZTL.37.62.F07.1.454.CMB.1.raw
  modified_base (433)..(441): a, c, t, g, unknown or other
  misc_feature (433)..(441): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtgggcaccctggtcactgtctcctcagcctccaccaaggcccatcggtcttcccctggccgccctgctccaggagcacctccgagacgcacagccggccctgggctgcctggtcaaggactacttccatctacactactgagcggctggcaaggcgcatagnnnnnnnnn

SEQ ID NO: 61655 - DNA, 469 bp, Homo sapiens
  misc_feature: GYAE6OF01CM9LZ.37.62.F07.1.454.CMB.1.raw
  modified_base (430)..(430): a, c, t, g, unknown or other
  misc_feature (430)..(430): n is a, c, g, or t
  modified_base (437)..(469): a, c, t, g, unknown or other
  misc_feature (437)..(469): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccgatctccagagacaattccaagaacaccctgtctctgcaaatgaacaacctgagagccgaggacacggccctatatactgtacgaaaatggcctacggatatgactactattgggactggtacttcgatctctggggccgtggcaccctggtcactgtctcctcagcctccaccaagggcccatcggtctccccctggcgccctgctccaggagccacctccgagacgcacagcggccctgggctcgcctggtcaggactacttccatcctacactactgagcggctgggcaagggcncatacgnnnnnnnnnnnnnnnnnnnnnnnnnnnnnnnnn

SEQ ID NO: 61656 - DNA, 437 bp, Homo sapiens
  misc_feature: GYAE6OF01A8FF7.37.62.F07.1.454.CMB.1.raw
  modified_base (433)..(437): a, c, t, g, unknown or other
  misc_feature (433)..(437): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 61657 - DNA, 461 bp, Homo sapiens
  misc_feature: GYAE6OF01CZSWY.37.62.F07.1.454.CMB.1.raw
  modified_base (406)..(406): a, c, t, g, unknown or other
  misc_feature (406)..(406): n is a, c, g, or t
  modified_base (430)..(461): a, c, t, g, unknown or other
  misc_feature (430)..(461): n is a, c, g, or t
tcagtagtgtagatcacgaccggtgctcgatttagtagtcgcataaagggaaggggacgtggagtgggtactcaggtattggtggcagtggtgagaccacatactacgcagactccgtgaagggccggttcaccatctccagagacaattccaagaacaccctgtctctgcaaatgaacaacctgagagccgaggacacggccctatattatgtgcgaaatgtggggggagtgggggctactcctggcgttttgactacgtgggggccaggggagccctggtcaccgtctcctcagcctccaccaagggcccatcggtcttccccctggcgccctgctccaggcgcacctccgagacgcacagcggcctgggctgcctggtcaaggactacttccatcacactacngagcggctggacaaggcgcatagnnnnnnnnnnnnnnnnnnnnnnnnnnnnnnnn

SEQ ID NO: 61658 - DNA, 436 bp, Homo sapiens
  misc_feature: GYAE6OF01EYOKR.37.62.F07.1.454.CMB.1.raw
  modified_base (429)..(436): a, c, t, g, unknown or other
  misc_feature (429)..(436): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctctcagcctcaccaagggcccatcggtcttccccctggcgccctgctcgaggagcacctccgagagcacagcgccctgggctgcctggtcaaggctacttccatctacattactgagcgggctggcaaggcgcatagnnnnnnnn

SEQ ID NO: 61659 - DNA, 443 bp, Homo sapiens
  misc_feature: GYAE6OF01AM6GI.37.62.F07.1.454.CMB.1.raw
  modified_base (436)..(443): a, c, t, g, unknown or other
  misc_feature (436)..(443): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgcccctgctccaggacgcacctccgagacgcacagcggccctgggctgcctggtcaaggctacttccatctacactactgagcgggctggcaaggcgcatagnnnnnnnn

SEQ ID NO: 61660 - DNA, 511 bp, Homo sapiens
  misc_feature: GYAE6OF01BRXFY.37.62.F07.1.454.CMB.1.raw
  modified_base (377)..(377): a, c, t, g, unknown or other
  misc_feature (377)..(377): n is a, c, g, or t
  modified_base (482)..(511): a, c, t, g, unknown or other
  misc_feature (482)..(511): n is a, c, g, or t
tcagtagtgtagatcacgaccggtgctcgatttagtagtcgcataaaaggggaaagggactggacgtgggtctcgaggtattggtggtcagtggtgagaccacatactacgcagactccgtgaagggccggttcaccatctccagagacaattccaagaacaccctgtctactgcaaatgaacaactgagagccgaggacacggccgtatattacgtgtaacgaaaagtcggccctaaggatatgactactattgggactggtacttcgatctgtggggccgtggcaccctggtcactggtctcctcacgcctccaaccaagggcccagtccgtcttccccgtggccaccctgcctcgagacgccacgtccggaggngcacgacgtccggccctggggacctggccgttgggacaagggacctacgttccactctaacaccgtagtcggaagccgggtctagggacaaaggccgatatagcnnnnnnnnnnnnnnnnnnnnnnnnnnnnnn

SEQ ID NO: 61661 - DNA, 436 bp, Homo sapiens
  misc_feature: GYAE6OF01BYPOD.37.62.F07.1.454.CMB.1.raw
  modified_base (429)..(436): a, c, t, g, unknown or other
  misc_feature (429)..(436): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattaatgtacgaaaatggcctacggatatgactactattgggactggtacttcgatctctgggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnnnn

SEQ ID NO: 61662 - DNA, 595 bp, Homo sapiens
  misc_feature: GYAE6OF01A2VMA.37.62.F07.1.454.CMB.1.raw
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
  modified_base (541)..(541): a, c, t, g, unknown or other
  misc_feature (541)..(541): n is a, c, g, or t
  modified_base (589)..(589): a, c, t, g, unknown or other
  misc_feature (589)..(589): n is a, c, g, or t
tcagtagtgtagatcacgaccggtgctcgatttagtagtcgcataaaggtaagggtacggtggagtagggtctcaggtattggtggcgagtggtgagaccacgatactagcgacgactccgtgaagggcccggttccaccgatcctccagagacaattccgaagaaccaccctgtctctgcaaatgaacaacctgagagccgacgacacggccctatacttacctgtacgaaatggcctacggatagtgactactattgggacctggtacttcgagtccgtcgtggggccgtgggcaccctggtactactggtcctcgtcagcctccaccgaacggccaagtccgtaccttcccctgcnccctgctccagngcacctcgagacgcgtacgacgccggccctgggtcctggccgtggtacgaacgggtaccttaccggttaccaagttccttaccaccttactcggaacgcggtactgggaccaacgggcctacgaacttacggctagangtcgtnactacgtntactagtactaagtgacngtacgtacgtgtcgtcgtacgacgacgacgacgacgtacactagacgngtgtcg

SEQ ID NO: 61663 - DNA, 425 bp, Homo sapiens
  misc_feature: GYAE6OF01BQYUE.37.62.F07.1.454.CMB.1.raw
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (415)..(415): a, c, t, g, unknown or other
  misc_feature (415)..(415): n is a, c, g, or t
  modified_base (418)..(425): a, c, t, g, unknown or other
  misc_feature (418)..(425): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccagggagccctggtcaccgtctcctcagcctcaccaagggccatcggtcttccccngcnccctgctcaggancacctcgagagcacagcgcctggctgcctggtcaaggctacttcatcacactctgacgcggctcggacaaggcacanagnnnnnnnn

SEQ ID NO: 61664 - DNA, 444 bp, Homo sapiens
  misc_feature: GYAE6OF01ALQQE.37.62.F07.1.454.CMB.1.raw
  modified_base (345)..(345): a, c, t, g, unknown or other
  misc_feature (345)..(345): n is a, c, g, or t
  modified_base (434)..(444): a, c, t, g, unknown or other
  misc_feature (434)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactatgggactggtacttcgatctctggggccgtggcaccctggtcactgtctcctcagcctccaccaagggcccatcggtcttcccctggcgccctgctccagganccacctccgagacgcacagcggccctgggctgcctggtcaaggactacttccatctacactactgagcgggctggcaagggcgcatagnnnnnnnnnnn

SEQ ID NO: 61665 - DNA, 440 bp, Homo sapiens
  misc_feature: GYAE6OF01CZ4AW.37.62.F07.1.454.CMB.1.raw
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
  modified_base (433)..(440): a, c, t, g, unknown or other
  misc_feature (433)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacagttccaagaacaccctgtctctgcaaatgaacaacctgagagccgaggacacggccctatattactgtacgaaaatggcctacggatatgactactattgggactggtacttcgatctctggggccgtggcacctggtcactgtctcctcagcctccaccaaggcccatcggtccttccccctggcnccctgcctccaggagcacctccgagngcacagcgccctgggctgcctggtcaaggactacttccatcctacactactgagcgggctggcaaggcgcatagnnnnnnnn

SEQ ID NO: 61666 - DNA, 441 bp, Homo sapiens
  misc_feature: GYAE6OF01A8X9O.37.62.F07.1.454.CMB.1.raw
  modified_base (428)..(428): a, c, t, g, unknown or other
  misc_feature (428)..(428): n is a, c, g, or t
  modified_base (435)..(441): a, c, t, g, unknown or other
  misc_feature (435)..(441): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggacgcacctccgagagcacagcggccctgggctgcctggtcaaggctacttccatctacactactgagcgggctggcaagggcncgatagnnnnnnn

SEQ ID NO: 61667 - DNA, 440 bp, Homo sapiens
  misc_feature: GYAE6OF01D94PN.37.62.F07.1.454.CMB.1.raw
  modified_base (402)..(402): a, c, t, g, unknown or other
  misc_feature (402)..(402): n is a, c, g, or t
  modified_base (431)..(440): a, c, t, g, unknown or other
  misc_feature (431)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagacgcacagcggccctgggctgcctggtcaaggctacttcatctacnctactgagcgggctggcaaggcgcatagnnnnnnnnnn

SEQ ID NO: 61668 - DNA, 443 bp, Homo sapiens
  misc_feature: GYAE6OF01C74F8.37.62.F07.1.454.CMB.1.raw
  modified_base (263)..(263): a, c, t, g, unknown or other
  misc_feature (263)..(263): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (428)..(428): a, c, t, g, unknown or other
  misc_feature (428)..(428): n is a, c, g, or t
  modified_base (434)..(443): a, c, t, g, unknown or other
  misc_feature (434)..(443): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctntggggccgtggcaccctggtcactgtctcctcagcctccaccaaggcccatcggtcttcccctggcnccctgctccaggancacctccgagacgcacaggccggccctgggctgcctggtcaaggactacttccatctacactactgagcgggctggcaagggcncatagnnnnnnnnnn

SEQ ID NO: 61669 - DNA, 436 bp, Homo sapiens
  misc_feature: GYAE6OF01BW5TC.37.62.F07.1.454.CMB.1.raw
  modified_base (431)..(436): a, c, t, g, unknown or other
  misc_feature (431)..(436): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattctaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnn

SEQ ID NO: 61670 - DNA, 438 bp, Homo sapiens
  misc_feature: GYAE6OF01CS0W1.37.62.F07.1.454.CMB.1.raw
  modified_base (347)..(347): a, c, t, g, unknown or other
  misc_feature (347)..(347): n is a, c, g, or t
  modified_base (426)..(426): a, c, t, g, unknown or other
  misc_feature (426)..(426): n is a, c, g, or t
  modified_base (432)..(438): a, c, t, g, unknown or other
  misc_feature (432)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatccggtcttcccctggcgccctgctccagganccacctccgagagcacagcggcctgggctgcctggtcaaggctacttccatctacactactgagcgggctggcagggcncatagnnnnnnn

SEQ ID NO: 61671 - DNA, 508 bp, Homo sapiens
  misc_feature: GYAE6OF01C1IJI.37.62.F07.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (472)..(472): a, c, t, g, unknown or other
  misc_feature (472)..(472): n is a, c, g, or t
  modified_base (475)..(479): a, c, t, g, unknown or other
  misc_feature (475)..(479): n is a, c, g, or t
  modified_base (481)..(492): a, c, t, g, unknown or other
  misc_feature (481)..(492): n is a, c, g, or t
  modified_base (494)..(506): a, c, t, g, unknown or other
  misc_feature (494)..(506): n is a, c, g, or t
  modified_base (508)..(508): a, c, t, g, unknown or other
  misc_feature (508)..(508): n is a, c, g, or t
tcagtagtgtagatcacgaccggtgctcgatttagtagtcgcataaagggaaagggacgtggaggtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaagtggcctacggatatgactactattgggactggtacttcgatctctggggcctggcaccctggtcactgtctcctcagcctccaccgaacgggccccatcggtccttcccccgnggccncccgtgctccagggacnccacctcganagcacngcgacccgtgggctgcctggtacaaggtacctacttccagttcctaactactacctggacggccgggtactgggacctaaggggccgaacagtagcancgnnnnngnnnnnnnnnnnntnnnnnnnnnnnnntn

SEQ ID NO: 61672 - DNA, 420 bp, Homo sapiens
  misc_feature: GYAE6OF01CJSNE.37.62.F07.1.454.CMB.1.raw
  modified_base (395)..(395): a, c, t, g, unknown or other
  misc_feature (395)..(395): n is a, c, g, or t
  modified_base (400)..(420): a, c, t, g, unknown or other
  misc_feature (400)..(420): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaacgccaagaactccgtgcatctgcaaatgaacagtctgagagccgaggacacggctatttatactgcgcgagagaaggactgggcgtttcgactacgtggggccagggacctggtcaccgtctctcagcctcaccaaggcccatcggtctcccctggcgcctgctccaggagcacctccgagagcacagcggccctgggctgcctggtcaaggctacttcatctacactactgagcgggctggcaaggcnatagnnnnnnnnnnnnnnnnnnnnn

SEQ ID NO: 61673 - DNA, 440 bp, Homo sapiens
  misc_feature: GYAE6OF01EF8K7.37.62.F07.1.454.CMB.1.raw
  modified_base (425)..(425): a, c, t, g, unknown or other
  misc_feature (425)..(425): n is a, c, g, or t
  modified_base (431)..(440): a, c, t, g, unknown or other
  misc_feature (431)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggagcacctccgagagcacagcggccctgggctgcctggtcaaggctacttccatctacactactgagcggctggcaggcncatagnnnnnnnnnn

SEQ ID NO: 61674 - DNA, 551 bp, Homo sapiens
  misc_feature: GYAE6OF01BHT60.37.62.F07.1.454.CMB.1.raw
  modified_base (359)..(359): a, c, t, g, unknown or other
  misc_feature (359)..(359): n is a, c, g, or t
  modified_base (505)..(505): a, c, t, g, unknown or other
  misc_feature (505)..(505): n is a, c, g, or t
  modified_base (511)..(512): a, c, t, g, unknown or other
  misc_feature (511)..(512): n is a, c, g, or t
  modified_base (515)..(515): a, c, t, g, unknown or other
  misc_feature (515)..(515): n is a, c, g, or t
  modified_base (518)..(522): a, c, t, g, unknown or other
  misc_feature (518)..(522): n is a, c, g, or t
  modified_base (524)..(525): a, c, t, g, unknown or other
  misc_feature (524)..(525): n is a, c, g, or t
  modified_base (527)..(527): a, c, t, g, unknown or other
  misc_feature (527)..(527): n is a, c, g, or t
  modified_base (529)..(534): a, c, t, g, unknown or other
  misc_feature (529)..(534): n is a, c, g, or t
  modified_base (536)..(547): a, c, t, g, unknown or other
  misc_feature (536)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
tcagtagtgtagatcacgaccggtgctcgattttagtagtcgcataaaagggaaaggggtacgtggtagtgggtctcaggtattgggtggcagtggtgagaccacaatactaacgcagactccgtgaagggccggttcaccatctccagacgacaatttccgaagaacacccctgtctctgcaaatggaacaaccgtgagagccgaggaaccacgggccctatacttactgtacgaaaattggcctacggatatgactactattgggactggtacttcgatcgtctggggccgtggcaccctggtcacgtgtctcctcagcctccaccaagggcccaatccggtcttcccccgtggccncccctgcctccgacggcgcccaccgtccggagacgccacacgcggccctgggcctcggcctacgggtaccaaacgggtaccttaaccgtttcccataccgttaccacgttaacgttggacggccgggctgggactaacgggccgtnagtagnngtncgnnnnntnngngnnnnnncnnnnnnnnnnnngngn

SEQ ID NO: 61675 - DNA, 438 bp, Homo sapiens
  misc_feature: GYAE6OF01EX9A5.37.62.F07.1.454.CMB.1.raw
  modified_base (433)..(438): a, c, t, g, unknown or other
  misc_feature (433)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatcctacactactgagcgggctggcaaggcgcatagnnnnnn

SEQ ID NO: 61676 - DNA, 437 bp, Homo sapiens
  misc_feature: GYAE6OF01A9QTP.37.62.F07.1.454.CMB.1.raw
  modified_base (427)..(427): a, c, t, g, unknown or other
  misc_feature (427)..(427): n is a, c, g, or t
  modified_base (433)..(437): a, c, t, g, unknown or other
  misc_feature (433)..(437): n is a, c, g, or t
tcagtagtgtagatcacgaccggtgctcgatttagtagtcgcataaagggaaagggactggagtgggtctcaggtattggtggcagtggtgagacaacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatctacactactgagcgggctggcaagggcncatagnnnnn

SEQ ID NO: 61677 - DNA, 443 bp, Homo sapiens
  misc_feature: GYAE6OF01BTKAV.37.62.F07.1.454.CMB.1.raw
  modified_base (346)..(346): a, c, t, g, unknown or other
  misc_feature (346)..(346): n is a, c, g, or t
  modified_base (425)..(425): a, c, t, g, unknown or other
  misc_feature (425)..(425): n is a, c, g, or t
  modified_base (431)..(443): a, c, t, g, unknown or other
  misc_feature (431)..(443): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgcctgctccaggacncacctcgagagcacagcggccctgggctgcctggtcaaggactacttccatctacactactgagcgggctggcaaggcncatagnnnnnnnnnnnnn

SEQ ID NO: 61678 - DNA, 455 bp, Homo sapiens
  misc_feature: GYAE6OF01AGNR4.37.62.F07.1.454.CMB.1.raw
  modified_base (334)..(334): a, c, t, g, unknown or other
  misc_feature (334)..(334): n is a, c, g, or t
  modified_base (430)..(430): a, c, t, g, unknown or other
  misc_feature (430)..(430): n is a, c, g, or t
  modified_base (436)..(455): a, c, t, g, unknown or other
  misc_feature (436)..(455): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatccggtcttcccctggccnccctgctccaggagcacctccgagagcacagcggccctgggctgcctggtcaaggactacttccatctacactactgagcgggctgggcaagggcncatagnnnnnnnnnnnnnnnnnnnn

SEQ ID NO: 61679 - DNA, 438 bp, Homo sapiens
  misc_feature: GYAE6OF01A3A1V.37.62.F07.1.454.CMB.1.raw
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (432)..(438): a, c, t, g, unknown or other
  misc_feature (432)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcctccccctggcgccctgctccaggagcacctccgagagcacagcggccctgggctgcctggtcaaggctactccatctacnctactgagcgggctggcaagggcncatagnnnnnnn

SEQ ID NO: 61680 - DNA, 471 bp, Homo sapiens
  misc_feature: GYAE6OF01EPMYY.37.62.F07.1.454.CMB.1.raw
  modified_base (448)..(448): a, c, t, g, unknown or other
  misc_feature (448)..(448): n is a, c, g, or t
  modified_base (455)..(471): a, c, t, g, unknown or other
  misc_feature (455)..(471): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccagtccggtccttcccccgtggccgcccctgcctccgaggacgccacctccgagacgcacgacgccggccctggggcctgccgtggtcaaaggcttacttccatctacactactgagcgggctgggacagggcncagtagnnnnnnnnnnnnnnnnn

SEQ ID NO: 61681 - DNA, 489 bp, Homo sapiens
  misc_feature: GYAE6OF01BQ33J.37.62.F07.1.454.CMB.1.raw
  modified_base (453)..(453): a, c, t, g, unknown or other
  misc_feature (453)..(453): n is a, c, g, or t
  modified_base (476)..(476): a, c, t, g, unknown or other
  misc_feature (476)..(476): n is a, c, g, or t
  modified_base (480)..(489): a, c, t, g, unknown or other
  misc_feature (480)..(489): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcacccgtggtcactgtctcctcacgccctaccaccgaacgggcccctagtcccgggttcccttcccccgtggcccgtcccctgcctccgaggacgccacccgtccgagacgccacgcggccggcccgtgggctcggtccgtggtacaacggtacctacttccatcctacacgtacgnggacggcggctggaccagggcanatgnnnnnnnnnn

SEQ ID NO: 61682 - DNA, 507 bp, Homo sapiens
  misc_feature: GYAE6OF01BZHO6.37.62.F07.1.454.CMB.1.raw
  modified_base (360)..(360): a, c, t, g, unknown or other
  misc_feature (360)..(360): n is a, c, g, or t
  modified_base (493)..(507): a, c, t, g, unknown or other
  misc_feature (493)..(507): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctcgtggggccgtggcaccctggtcactgtctcctcacgcctccaccgaacgggcccagtccggtccttcccccgtggccgcccctgcctccgaggacnccacctccgagacgcacgacggccggcccgtggggcctcggccctgggtaccaaacgggtaccttaccgttccacttcctaacaaccttacgtggacggcgggtcgtgggaccgaacgggcgacaacgtagcnnnnnnnnnnnnnnn

SEQ ID NO: 61683 - DNA, 438 bp, Homo sapiens
  misc_feature: GYAE6OF01A3NGF.37.62.F07.1.454.CMB.1.raw
  modified_base (432)..(438): a, c, t, g, unknown or other
  misc_feature (432)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnnn

SEQ ID NO: 61684 - DNA, 491 bp, Homo sapiens
  misc_feature: GYAE6OF01EO2DR.37.62.F07.1.454.CMB.1.raw
  modified_base (458)..(458): a, c, t, g, unknown or other
  misc_feature (458)..(458): n is a, c, g, or t
  modified_base (460)..(491): a, c, t, g, unknown or other
  misc_feature (460)..(491): n is a, c, g, or t
tcagtagtgtagatcacgaccggtgctcgatttagtagtcgcataaagggaaaggggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctaggatatgactactattgggactggtacttcgatctctggggccgtggcaccctggtcactgtctcctcagcctccaccaagggcccatcggtcttcccctcgcgccctcgctccacggagcaccctccgacgagaccacacggcggcccgtcgggcgtcgccgtcggtcgaacggacttacttccactactaccactactgacgcgggtcgtggacgacggcgcagtagngnnnnnnnnnnnnnnnnnnnnnnnnnnnnnnnn

SEQ ID NO: 61685 - DNA, 562 bp, Homo sapiens
  misc_feature: GYAE6OF01E0MHT.37.62.F07.1.454.CMB.1.raw
  modified_base (468)..(468): a, c, t, g, unknown or other
  misc_feature (468)..(468): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
tcagtagtgtagatcacgaccggtgctcgatttagtagtcgcataaagggggggtccctgagactctcctgtgcagcttcaggattcagctttagcagctacgccatgagctgggtccgccaggctccagggaagggactggagtgggtctcaggtattggtggcagtggtgagaccacatactacgcagactccgtgaagggccggttcaccatctccagagacaattccaagaaccaccctgtctctgcaaatgaacaacctgagagccgaggacacggcctatattactgtacgaaaatggcctacggatatgactactagttgggactggtacttcgatctcgtggggccgtggcacccgtggtccactcgtcctcctcacgccctccaccgaacgggcccctagtccggtcccttccccgtggtcccgcccttgcctcccgaggcgccacctcgacgcgcacnggccggccccgtgggcctcgcccgtggtacaaggtacctacttcccatccgtacaccttacgtgacggcgggctcgggactaagggcngngtag

SEQ ID NO: 61686 - DNA, 447 bp, Homo sapiens
  misc_feature: GYAE6OF01DYNC1.37.62.F07.1.454.CMB.1.raw
  modified_base (429)..(429): a, c, t, g, unknown or other
  misc_feature (429)..(429): n is a, c, g, or t
  modified_base (435)..(447): a, c, t, g, unknown or other
  misc_feature (435)..(447): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatctacactactgagcgggctgggcaagggcncatagnnnnnnnnnnnnn

SEQ ID NO: 61687 - DNA, 439 bp, Homo sapiens
  misc_feature: GYAE6OF01D5BFF.37.62.F07.1.454.CMB.1.raw
  modified_base (435)..(439): a, c, t, g, unknown or other
  misc_feature (435)..(439): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggacgcacctccgagagcacagcggccctgggctgcctggtcaaggctacttccatctacactactgagcgggctggcaaggcgcatagnnnnn

SEQ ID NO: 61688 - DNA, 435 bp, Homo sapiens
  misc_feature: GYAE6OF01ASRUN.37.62.F07.1.454.CMB.1.raw
  modified_base (430)..(435): a, c, t, g, unknown or other
  misc_feature (430)..(435): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcggctggcaaggcgcatagnnnnnn

SEQ ID NO: 61689 - DNA, 433 bp, Homo sapiens
  misc_feature: GYAE6OF01D5S4Q.37.62.F07.1.454.CMB.1.raw
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (421)..(421): a, c, t, g, unknown or other
  misc_feature (421)..(421): n is a, c, g, or t
  modified_base (427)..(433): a, c, t, g, unknown or other
  misc_feature (427)..(433): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctcgtggggccgtggcaccctggtcactgtctcctcagcctccaccaaggcccatcggtctcccctggcnccctgctcaggancacctcgagngcacagcgccctgggctgcctggtcaaggactactccatctacactactgagcggctggcaaggcncatagnnnnnnn

SEQ ID NO: 61690 - DNA, 435 bp, Homo sapiens
  misc_feature: GYAE6OF01BPR31.37.62.F07.1.454.CMB.1.raw
  modified_base (345)..(345): a, c, t, g, unknown or other
  misc_feature (345)..(345): n is a, c, g, or t
  modified_base (422)..(422): a, c, t, g, unknown or other
  misc_feature (422)..(422): n is a, c, g, or t
  modified_base (427)..(435): a, c, t, g, unknown or other
  misc_feature (427)..(435): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggancacctccgagagcacagcgccctggctgcctggtcaaggctacttccatctacactactgagcgggctggcaaggcncatgnnnnnnnnn

SEQ ID NO: 61691 - DNA, 462 bp, Homo sapiens
  misc_feature: GYAE6OF01DJ8BX.37.62.F07.1.454.CMB.1.raw
  modified_base (449)..(462): a, c, t, g, unknown or other
  misc_feature (449)..(462): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccgaacgggcccatccggtccttccccctggccgcccctgcctccgaggacgccacctccgagagccacgacgccggccctgggcctgccctggtcaaggactacttccatctacactactgagcgggctggcaaggcgcatagnnnnnnnnnnnnnn

SEQ ID NO: 61692 - DNA, 475 bp, Homo sapiens
  misc_feature: GYAE6OF01DUHHS.37.62.F07.1.454.CMB.1.raw
  modified_base (210)..(210): a, c, t, g, unknown or other
  misc_feature (210)..(210): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (460)..(475): a, c, t, g, unknown or other
  misc_feature (460)..(475): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattacngtacgaaaatggcctacggatatgactactattgggactggtacttcgatctctggggccgtggcaccctggtcactgtctcctcacgcctcccaccaagggccccatccggtcttcccccgtggccnccctgcctccaggcnccacctccgagacgccacacgccggcccctgggcctcggccctgggtacaaggtactaccttccgattcctaacactacgtgacgcgggctgggcaaggcgcatagnnnnnnnnnnnnnnnn

SEQ ID NO: 61693 - DNA, 461 bp, Homo sapiens
  misc_feature: GYAE6OF01A1CPV.37.62.F07.1.454.CMB.1.raw
  modified_base (431)..(431): a, c, t, g, unknown or other
  misc_feature (431)..(431): n is a, c, g, or t
  modified_base (433)..(461): a, c, t, g, unknown or other
  misc_feature (433)..(461): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccgtctccagagacaattccaagaatacggtctatctggaaatgaacagcctgagagccgaggacacggccctctattactgtgcgagagatcagacggatatagcagcagctctgactacgtgggccacggaaccctggtcaccgtctcctcagcctccaccaacgggcccagtccggtccttcccccctaggccacccctcctaccaagacgcacctcgtggggcacgagcgcccgtggctgcctgtcaaggactactccatcacactactgacgcggctggacaaggcgacagtacgcngnnnnnnnnnnnnnnnnnnnnnnnnnnnnn

SEQ ID NO: 61694 - DNA, 437 bp, Homo sapiens
  misc_feature: GYAE6OF01EOM37.37.62.F07.1.454.CMB.1.raw
  modified_base (432)..(437): a, c, t, g, unknown or other
  misc_feature (432)..(437): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 61695 - DNA, 530 bp, Homo sapiens
  misc_feature: GYAE6OF01DMPLR.37.62.F07.1.454.CMB.1.raw
  modified_base (286)..(286): a, c, t, g, unknown or other
  misc_feature (286)..(286): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
  modified_base (527)..(528): a, c, t, g, unknown or other
  misc_feature (527)..(528): n is a, c, g, or t
tcagtagtgtagatcacgaccggtgctcgatttagtagtcgcataaagggggggtccctgagactctcctgtgcagcttcaggattcagctttagcagctacgccatgagctgggtccgccaggctccagggaagggactggagtgggtctcaggtattggtggcagtggtgagaccacatactacgcagactccgtgaagggccggttcaccatctccagagacaattccaagaaccaccctgtctctgcaaatgaacaacctgagagccgaggacacggccctntattactgtgcgagagatcaagacggagtatagcagcagctcngactacgngggccacggacctgccaccgtctcctncgcctccaaccacgggcccatccgtccttccccngccnccctcctacacgcnccacctcgtgggcacgacgccggccgtcgggctcggccgtggtacaacggtaccttacctccacttccacctactacgtagacggcgggcgtggaccaacggcgacatagnncg

SEQ ID NO: 61696 - DNA, 434 bp, Homo sapiens
  misc_feature: GYAE6OF01EVMZR.37.62.F07.1.454.CMB.1.raw
  modified_base (330)..(330): a, c, t, g, unknown or other
  misc_feature (330)..(330): n is a, c, g, or t
  modified_base (431)..(434): a, c, t, g, unknown or other
  misc_feature (431)..(434): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccagggcccatcggtcttcccctggcnccctgctccaggagcacctccgagagcacagcggccctgggcctgcctggtcaaggactacttccatctacactactgagcgggctggcaaggcgcatagnnnn

SEQ ID NO: 61697 - DNA, 439 bp, Homo sapiens
  misc_feature: GYAE6OF01BR55Q.37.62.F07.1.454.CMB.1.raw
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
  modified_base (432)..(439): a, c, t, g, unknown or other
  misc_feature (432)..(439): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgngcgggctggcaagggcncatgnnnnnnnn

SEQ ID NO: 61698 - DNA, 467 bp, Homo sapiens
  misc_feature: GYAE6OF01C2AQD.37.62.F07.1.454.CMB.1.raw
  modified_base (327)..(327): a, c, t, g, unknown or other
  misc_feature (327)..(327): n is a, c, g, or t
  modified_base (443)..(467): a, c, t, g, unknown or other
  misc_feature (443)..(467): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacctggtcactgtctcctcagcctccacaagggcccatcggtcttcccccgnggccgcctgcctccaggacgccacctccgagacgcacagccggcctgggctgcctggtacaacggactacttccatctaacactactgacgcgggtctggacaaggcgcatacggnnnnnnnnnnnnnnnnnnnnnnnnn

SEQ ID NO: 61699 - DNA, 723 bp, Homo sapiens
  misc_feature: GYAE6OF01BMN1Z.37.62.F07.1.454.CMB.1.raw
  modified_base (186)..(186): a, c, t, g, unknown or other
  misc_feature (186)..(186): n is a, c, g, or t
  modified_base (684)..(684): a, c, t, g, unknown or other
  misc_feature (684)..(684): n is a, c, g, or t
  modified_base (688)..(692): a, c, t, g, unknown or other
  misc_feature (688)..(692): n is a, c, g, or t
  modified_base (694)..(694): a, c, t, g, unknown or other
  misc_feature (694)..(694): n is a, c, g, or t
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
  modified_base (701)..(723): a, c, t, g, unknown or other
  misc_feature (701)..(723): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagngacgagacgacgcctattattactagtaaacgaaagtcgaccgtaaggaattagtacgaacttaacttaggttacgggtacgttcggttacgtttacgtattccgttcgggtccggggtccggtcggaccctacccggttggtacctacgttcgttcctccgtacgaccgtcccctacccgaaaccggaaccgggccccttaggttcccggtttccccctttccccggtcgggtccccgtcccgttacggacccgttaccggaacggggacctaccccgtaacccggttacccggaaaggaccgaccaaccggaccgggtccccggtaccccgggttcggtccgtccggtacccggttaccgggtaaaccggtaaaccggttaccctttacccgttaaccctacgtttaaccccttaaacgtcccgttaaacggtggggaaccccgggtccggggtaccggtaacggaaccgggtaaccggggccaaagtaacggtancgcnnnnncngngtnannnnnnnnnnnnnnnnnnnnnnn

SEQ ID NO: 61700 - DNA, 436 bp, Homo sapiens
  misc_feature: GYAE6OF01A3RWQ.37.62.F07.1.454.CMB.1.raw
  modified_base (430)..(436): a, c, t, g, unknown or other
  misc_feature (430)..(436): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaggactacttccatctacactactgagcgggctggcaaggcgcatagnnnnnnn

SEQ ID NO: 61701 - DNA, 615 bp, Homo sapiens
  misc_feature: GYAE6OF01A8YYJ.37.62.F07.1.454.CMB.1.raw
  modified_base (512)..(512): a, c, t, g, unknown or other
  misc_feature (512)..(512): n is a, c, g, or t
tcagtagtgtagatcacgaccggtgctcgatttagtagtcgcataaagggaaaggggactggagtgggtctcgacggtattgggtggcagtggtcgagaccacatactacgcagactccgtgaaggccggttcaccatctccagagacaattccaagaacacctgtctctgcaaatgaacaacctgagagccgaggacacggccgtaatatactgtacgaaaatggcctacggatatgactactattgggactggtaacttcgatctctgggcctggcaccgtggtcactgtctcctcacgcctccacaagggcccatccggtctcccgtgccgcctgctccacggtgccacgtccgagagtcgaacacggccggacccgtgggccttcgcccgttcggtaccaaacgggccttaaccgtttccaacgttccttaaaccgaccgttaacgtcggaaacggtccgggtacttagggaccgttaaacgggcgtaccgaagttaacggcagtaanacgtacgtacgacgtacgtacgtacgacgtacgtacgacgagacgtacgacgtacgagtcgtagtcgtacgacgtacgtacgtacgtactagtctcgtcgacg

SEQ ID NO: 61702 - DNA, 444 bp, Homo sapiens
  misc_feature: GYAE6OF01AC7BP.37.62.F07.1.454.CMB.1.raw
  modified_base (346)..(346): a, c, t, g, unknown or other
  misc_feature (346)..(346): n is a, c, g, or t
  modified_base (428)..(428): a, c, t, g, unknown or other
  misc_feature (428)..(428): n is a, c, g, or t
  modified_base (434)..(444): a, c, t, g, unknown or other
  misc_feature (434)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccagggcccatcggtcttccccctggccgccctgctccaggngcacctccgagacgcacagcggccctgggctgcctggtcaaggactacttccatctacactactgagcgggctggcagggcncatagnnnnnnnnnnn

SEQ ID NO: 61703 - DNA, 474 bp, Homo sapiens
  misc_feature: GYAE6OF01CIRPP.37.62.F07.1.454.CMB.1.raw
  modified_base (446)..(446): a, c, t, g, unknown or other
  misc_feature (446)..(446): n is a, c, g, or t
  modified_base (454)..(474): a, c, t, g, unknown or other
  misc_feature (454)..(474): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccgaagggcccaatccggtccttccccccgtggccgtccctgcctccaggacgccacctccgagacgcacagccggccctgggctcgcctggtacaaggactacttccatctaacactactgagcgggctggacaacgggcncagtagcnnnnnnnnnnnnnnnnnnnnn

SEQ ID NO: 61704 - DNA, 460 bp, Homo sapiens
  misc_feature: GYAE6OF01DQGFZ.37.62.F07.1.454.CMB.1.raw
  modified_base (336)..(336): a, c, t, g, unknown or other
  misc_feature (336)..(336): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
  modified_base (448)..(460): a, c, t, g, unknown or other
  misc_feature (448)..(460): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctctggggccgtggccacctggtcactgtctcctcagcctccaccgaacgggcccatccggtcctttccccccnggccgccctgcctccgaggacgcacctccggagtacgcacagccggccctgggcctgcctggtcaggtactacttccatctacactactgagcgggntggcaaggcnatagnnnnnnnnnnnnn

SEQ ID NO: 61705 - DNA, 440 bp, Homo sapiens
  misc_feature: GYAE6OF01BTXZE.37.62.F07.1.454.CMB.1.raw
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
  modified_base (433)..(440): a, c, t, g, unknown or other
  misc_feature (433)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtcttcccctggcnccctgctccaggagcacctccgagagcacagccggccctgggctgccctggtcaaggctacttccatctacactactgagcgggctggcaagggcncatagnnnnnnnn

SEQ ID NO: 61706 - DNA, 446 bp, Homo sapiens
  misc_feature: GYAE6OF01EWCIA.37.62.F07.1.454.CMB.1.raw
  modified_base (352)..(352): a, c, t, g, unknown or other
  misc_feature (352)..(352): n is a, c, g, or t
  modified_base (438)..(446): a, c, t, g, unknown or other
  misc_feature (438)..(446): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccatccggtcttccccctggccgccctgcctccaggacncacctccgagacgcacagcggccctgggctgccgtggtcaaggactacttccatctacactctgacgcggctggcaaggcgcatgnnnnnnnnn

SEQ ID NO: 61707 - DNA, 442 bp, Homo sapiens
  misc_feature: GYAE6OF01EVBJJ.37.62.F07.1.454.CMB.1.raw
  modified_base (330)..(330): a, c, t, g, unknown or other
  misc_feature (330)..(330): n is a, c, g, or t
  modified_base (434)..(442): a, c, t, g, unknown or other
  misc_feature (434)..(442): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaatttccaagaacaccctgtctctgcaaatgaacaacctgagagccgaggacacggcctatattactgtacgaaaaatggcctacggatatgactactattgggactggtacttcgatctctggggccgtggcaccctggtcactgtctcctcagcctccaccaagggcccatcggtcttcccccnggccgccctgctccaggagcacctccgagagcacagcggccctgggctgcctggtcaaggctacttccatctacactactgagcgggctggcaaggcgcatagnnnnnnnnn

SEQ ID NO: 61708 - DNA, 507 bp, Homo sapiens
  misc_feature: GYAE6OF01BC1MU.37.62.F07.1.454.CMB.1.raw
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (454)..(458): a, c, t, g, unknown or other
  misc_feature (454)..(458): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (502)..(503): a, c, t, g, unknown or other
  misc_feature (502)..(503): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagtagtgtagatcacgaccggtgctcgatttagtagtcgcataaagggaaaggggactggagtgggtctcaggtattggtgggcagtggtgagaccacatactacggccagactccgtgaagggccggttcgaccatctccagagacaagttccaagaacaccctgtctctgcaaatgaacaacctgacgagccgaggacaccggccctatattactgtacgaaaatggcctacggatatgactactatgggactggtacttcgatctcgtgggcctggcaccctggtcactgtctctcagcctaccacgaagggcccagtccggtccttccccgnggccgtccctgcctccgaggacnccacctccgagcgcacncgccggtccgtggctcgcctggtacaaggtctacgtcatctacactactgacgcggctggcaacggcgacatacgnnnnncgntatcntgactagctncnacntgcgcgngcgntagngnacanngngn

SEQ ID NO: 61709 - DNA, 442 bp, Homo sapiens
  misc_feature: GYAE6OF01DQKOF.37.62.F07.1.454.CMB.1.raw
  modified_base (264)..(264): a, c, t, g, unknown or other
  misc_feature (264)..(264): n is a, c, g, or t
  modified_base (431)..(442): a, c, t, g, unknown or other
  misc_feature (431)..(442): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctntggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnnnnnnnn

SEQ ID NO: 61710 - DNA, 555 bp, Homo sapiens
  misc_feature: GYAE6OF01B91A7.37.62.F07.1.454.CMB.1.raw
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
  modified_base (527)..(528): a, c, t, g, unknown or other
  misc_feature (527)..(528): n is a, c, g, or t
  modified_base (530)..(555): a, c, t, g, unknown or other
  misc_feature (530)..(555): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactatggactggtacttcgatctcgtggggccgtggcaccctggtcactgtctcctcacgcctccaccaacgggcccagtccggtccttccccctggccgccctgcctccgaggacgccaccgtccgagacgccacgacggccggcccgtcgggctcggcccgtgggtaccgaaacgggtacccttaacgttcccaattcccgtaacctaccgttaaccgtcgggtaacggccggggtaccgttcggggacccgaaaggggcccgacgtaaacgtaaggcagcngcngnngnnnnnnnnnnnnnnnnnnnnnnnnnn

SEQ ID NO: 61711 - DNA, 548 bp, Homo sapiens
  misc_feature: GYAE6OF01DW0I7.37.62.F07.1.454.CMB.1.raw
  modified_base (353)..(353): a, c, t, g, unknown or other
  misc_feature (353)..(353): n is a, c, g, or t
  modified_base (515)..(515): a, c, t, g, unknown or other
  misc_feature (515)..(515): n is a, c, g, or t
  modified_base (517)..(522): a, c, t, g, unknown or other
  misc_feature (517)..(522): n is a, c, g, or t
  modified_base (524)..(548): a, c, t, g, unknown or other
  misc_feature (524)..(548): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattactgtacgaaaatggcctacggatatgactactagttgggactggtacttcgatctcgtgggccgtggcacctggtcactgtctcctcacgcctccaccgacggcccagtccggtccttccccgtggccgccctgcctccgaggcnccaccgtccgagacgcacgacggccggcccgtgggcctcggtcccgttagggtaccgaaacgggtaccttaccgtttacccacttaccttaaccaccgttaccgttgggacgggtccggggtaccgtcgggaaccgtaacggggccgaccgtaagttacgcngnnnnnngnnnnnnnnnnnnnnnnnnnnnnnnn

SEQ ID NO: 61712 - DNA, 471 bp, Homo sapiens
  misc_feature: GYAE6OF01D2TVD.37.62.F07.1.454.CMB.1.raw
  modified_base (354)..(354): a, c, t, g, unknown or other
  misc_feature (354)..(354): n is a, c, g, or t
  modified_base (459)..(471): a, c, t, g, unknown or other
  misc_feature (459)..(471): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctcgtggggccgtggcaccctggtcactgtctcctcagccctccaccagggcccagtccgtccttccccctggccgccctgcctccaggacnccacctccgagacgcacgacgcggccctgggctcgccgtggtacaacggtactaccttccatactaccactactggaggcgggctcggacagggcgtacagtagnnnnnnnnnnnnn

SEQ ID NO: 61713 - DNA, 451 bp, Homo sapiens
  misc_feature: GYAE6OF01EQS78.37.62.F07.1.454.CMB.1.raw
  modified_base (445)..(451): a, c, t, g, unknown or other
  misc_feature (445)..(451): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatccggtcttccccctggccaccctcctccaagacgccacctcctggggggccacgacgcggccctggggcctggccgtggtcaaggactacttccatctacactactgagcgggctggcaaggcgcatgnnnnnnn

SEQ ID NO: 61714 - DNA, 545 bp, Homo sapiens
  misc_feature: GYAE6OF01BS51T.37.62.F07.1.454.CMB.1.raw
  modified_base (360)..(360): a, c, t, g, unknown or other
  misc_feature (360)..(360): n is a, c, g, or t
  modified_base (518)..(545): a, c, t, g, unknown or other
  misc_feature (518)..(545): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattactgtaacgaaaatggcctaggatatgactactagttgggactggtacttgatctcgtggggccgtggccacccgtggtcactgtcctcctcacgcctccaccaacgggccctagtccggtccttccccctggcctccctgcctccgaggacnccgacctccgagacgacacgacggcccggcccgtgggcctcggtcccgttgggtaccgaaacgggtaccttaccgttccgtaacttaccgttaacctaaccgttacgtggtaacgggtcccgggagttacgggacgaacgggccgacgtaagtacggnnnnnnnnnnnnnnnnnnnnnnnnnnnn

SEQ ID NO: 61715 - DNA, 473 bp, Homo sapiens
  misc_feature: GYAE6OF01AO23T.37.62.F07.1.454.CMB.1.raw
  modified_base (352)..(352): a, c, t, g, unknown or other
  misc_feature (352)..(352): n is a, c, g, or t
  modified_base (417)..(417): a, c, t, g, unknown or other
  misc_feature (417)..(417): n is a, c, g, or t
  modified_base (449)..(473): a, c, t, g, unknown or other
  misc_feature (449)..(473): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatccggtccttccccctggccgcccctgctccaggacnccacctccgagagcacagcggcccctgggctgcctggtcaaggactacttccatctacactacgngagcgggcgtcggacaagggtcgacagtacgnnnnnnnnnnnnnnnnnnnnnnnnn

SEQ ID NO: 61716 - DNA, 524 bp, Homo sapiens
  misc_feature: GYAE6OF01ATMVX.37.62.F07.1.454.CMB.1.raw
  modified_base (367)..(367): a, c, t, g, unknown or other
  misc_feature (367)..(367): n is a, c, g, or t
  modified_base (497)..(524): a, c, t, g, unknown or other
  misc_feature (497)..(524): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtcctcctcacgcctcccaccgaacgggccccatccggtcccttcccccgtgggcccgtcccctgcctcccgaggacnccacccgtccggagacgccaacgacggcccggcccgtgggcctggcccgtgggtaccaaacgggtaccttaccttccacttcctaaccactacgtggacggccgggctggaccgaaggccgacagtacgnnnnnnnnnnnnnnnnnnnnnnnnnnnn

SEQ ID NO: 61717 - DNA, 437 bp, Homo sapiens
  misc_feature: GYAE6OF01DHSJK.37.62.F07.1.454.CMB.1.raw
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
  modified_base (426)..(437): a, c, t, g, unknown or other
  misc_feature (426)..(437): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctcaccaggccatcggtctcccctgcnccctgctcaggacncacctccgagacgcacagccggcctgggctcgcctggtcaaggctactcatcacactactgagcgggctggccaaggcacatacgnnnnnnnnnnnn

SEQ ID NO: 61718 - DNA, 436 bp, Homo sapiens
  misc_feature: GYAE6OF01DDH0E.37.62.F07.1.454.CMB.1.raw
  modified_base (331)..(331): a, c, t, g, unknown or other
  misc_feature (331)..(331): n is a, c, g, or t
  modified_base (408)..(408): a, c, t, g, unknown or other
  misc_feature (408)..(408): n is a, c, g, or t
  modified_base (430)..(436): a, c, t, g, unknown or other
  misc_feature (430)..(436): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaaggcccatcggtcctcccctggcncctgctccaggacgcacctccgagagcacacgcggccctgggctgcctggtcaaggactacttcatcctacactacngagcggctggcaggcgcatagnnnnnnn

SEQ ID NO: 61719 - DNA, 441 bp, Homo sapiens
  misc_feature: GYAE6OF01DPYX2.37.62.F07.1.454.CMB.1.raw
  modified_base (427)..(427): a, c, t, g, unknown or other
  misc_feature (427)..(427): n is a, c, g, or t
  modified_base (433)..(441): a, c, t, g, unknown or other
  misc_feature (433)..(441): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagccctccaccaagggcccatcggtccttcccctggcgccctgctccaggacgcaccctccgagagcacagccggccctgggctgcctggtcaaggctactccatctacactctgagcggctggcaaggcgnagtagnnnnnnnnn

SEQ ID NO: 61720 - DNA, 507 bp, Homo sapiens
  misc_feature: GYAE6OF01EUN51.37.62.F07.1.454.CMB.1.raw
  modified_base (356)..(356): a, c, t, g, unknown or other
  misc_feature (356)..(356): n is a, c, g, or t
  modified_base (480)..(481): a, c, t, g, unknown or other
  misc_feature (480)..(481): n is a, c, g, or t
  modified_base (483)..(507): a, c, t, g, unknown or other
  misc_feature (483)..(507): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttgatctcgtggggccgtggcacccgtggtcactgtctcctcacgcctccaccaacgggcccagttccggtccttccccctggccgccctgctcccaggacnccaccctccggagacgccgacacgccggccccgtgggcctggcccgtggtacgaacggtacttaccgttccatcctaccactacgtggacggtccgggctcgggacaagggccgacgaagtagnncnnnnnnnnnnnnnnnnnnnnnnnnn

SEQ ID NO: 61721 - DNA, 556 bp, Homo sapiens
  misc_feature: GYAE6OF01DTO59.37.62.F07.1.454.CMB.1.raw
  modified_base (521)..(521): a, c, t, g, unknown or other
  misc_feature (521)..(521): n is a, c, g, or t
  modified_base (524)..(529): a, c, t, g, unknown or other
  misc_feature (524)..(529): n is a, c, g, or t
  modified_base (531)..(556): a, c, t, g, unknown or other
  misc_feature (531)..(556): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggccaccctggtcacttgtcctcctcacgccctcccaaccgaacgggcccctagttccggtccctttccccccgtggcccgccccttgcctccgaggcgccacctccgagacgcacgacggccggccccgtggggccttcggcccgttcgggtaccaacgggtaccgtttaccttccgaacttcccgtaactaccttacgtcggacgggccgggtcgtacgggaccgaacgggccgactagtacggncgnnnnnngnnnnnnnnnnnnnnnnnnnnnnnnnn

SEQ ID NO: 61722 - DNA, 445 bp, Homo sapiens
  misc_feature: GYAE6OF01AVCAX.37.62.F07.1.454.CMB.1.raw
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (435)..(445): a, c, t, g, unknown or other
  misc_feature (435)..(445): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtccttccccctggccgccctgcctccgaggacgcacctccgagagcacagcggccctgggctgcctggtcaagctactccatctacnctactgagcgggctggcagggcncatagnnnnnnnnnnn

SEQ ID NO: 61723 - DNA, 520 bp, Homo sapiens
  misc_feature: GYAE6OF01BVDKB.37.62.F07.1.454.CMB.1.raw
  modified_base (356)..(356): a, c, t, g, unknown or other
  misc_feature (356)..(356): n is a, c, g, or t
  modified_base (497)..(520): a, c, t, g, unknown or other
  misc_feature (497)..(520): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccgaacgggcccatccggtccttcccccgtggccgtccctgcctccaggacnccaccctccggagacgccaacacggcccggccccgttggggcctcggcccgtagggtaccaaacgggtaccttaccgttccaatcctaaccaccttacgtcggaggccgggctagggaccgtaacgggccgacgataggcnnnnnnnnnnnnnnnnnnnnnnnn

SEQ ID NO: 61724 - DNA, 448 bp, Homo sapiens
  misc_feature: GYAE6OF01D0BSF.37.62.F07.1.454.CMB.1.raw
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (399)..(399): a, c, t, g, unknown or other
  misc_feature (399)..(399): n is a, c, g, or t
  modified_base (425)..(448): a, c, t, g, unknown or other
  misc_feature (425)..(448): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggcctggcaccctggtcactgtctcctcagcctcaccaaggcccatcggtccttccccnggcgccctgctccnggacgcaccncgagagcacagcgcctgggctgcctgtcaaggctacttcatctacactntgagcggctggccaaggcgcatacgnnnnnnnnnnnnnnnnnnnnnnnn

SEQ ID NO: 61725 - DNA, 433 bp, Homo sapiens
  misc_feature: GYAE6OF01CKVOQ.37.62.F07.1.454.CMB.1.raw
  modified_base (327)..(327): a, c, t, g, unknown or other
  misc_feature (327)..(327): n is a, c, g, or t
  modified_base (399)..(399): a, c, t, g, unknown or other
  misc_feature (399)..(399): n is a, c, g, or t
  modified_base (421)..(433): a, c, t, g, unknown or other
  misc_feature (421)..(433): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactatgggactggtactcgatctctgggccgtggcacctggtcactgtctcctcagcctcaccaagggcccatcggtctcccctggccncctcctccaagagcacctcgtgggggcacagccggcctgggctgcctggtcaaggctactcatcacactacngagcggcgtggcaaggcgcatnnnnnnnnnnnnn

SEQ ID NO: 61726 - DNA, 561 bp, Homo sapiens
  misc_feature: GYAE6OF01CNJR1.37.62.F07.1.454.CMB.1.raw
  modified_base (235)..(235): a, c, t, g, unknown or other
  misc_feature (235)..(235): n is a, c, g, or t
  modified_base (530)..(561): a, c, t, g, unknown or other
  misc_feature (530)..(561): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctcagagacaattccaagaacaccctgtctctgcaaatgaacaacctgagagccgaggacacggccctctattactggtgcgagagatcaagacggagtanagcagcagctctgactacgtgggaccacggaacctggtcaccgtctcctcacgcccctacacccgaacggggcccctagtccggttcccttccccctgggcccaccctcctaccaaacgacgccaccgtccggtcggggaccaacgacggccggccccgtggggtcctcgggccgttgggttaccgaaacgggtaccctttaaccgtttacccaacgttacccttaaccaaccgttaccgtagggaccgggtccgggccgttacgggacgaaacgggccgtacctaagtacggcnnnnnnnnnnnnnnnnnnnnnnnnnnnnnnnn

SEQ ID NO: 61727 - DNA, 612 bp, Homo sapiens
  misc_feature: GYAE6OF01CZ1CW.37.62.F07.1.454.CMB.1.raw
  modified_base (577)..(577): a, c, t, g, unknown or other
  misc_feature (577)..(577): n is a, c, g, or t
  modified_base (582)..(612): a, c, t, g, unknown or other
  misc_feature (582)..(612): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaaagaacaccctgtctctgacaaaatgaacaacctgagagccgaggacacggccctatatactgtacgaaaatgcctacggatatgaactactattgggactggtacttgatctcgtggggccgtggccacccgtggtcactgtcctcctcacgcctccaaccgaacgggccctagtccggtcccttcccccgtgggccctcccctacgccgtacccgacgggacgccctaccgtcccggagaccgaccgaacgaccgggcccgggtacccccggttggggcccttcgggtccccgtttacggggtaaccgtaaaaccgggttacccttaccctttacccaacgtttaccctaaacctaaccgttaacggtacgggaacgggtccgggggacttaggggacccgaacggggcgaccggtaagacgncacgnnnnnnnnnnnnnnnnnnnnnnnnnnnnnnn

SEQ ID NO: 61728 - DNA, 552 bp, Homo sapiens
  misc_feature: GYAE6OF01DJON9.37.62.F07.1.454.CMB.1.raw
  modified_base (520)..(525): a, c, t, g, unknown or other
  misc_feature (520)..(525): n is a, c, g, or t
  modified_base (527)..(552): a, c, t, g, unknown or other
  misc_feature (527)..(552): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagccctccaccgaacgggcccagttccggtcccttcccccgtggcccgcccttgcctccgaggacgccaccgtccgagacgcacgacggcggccccgtgggcctcggcccgtcgggtacgaaacgggtaccttaccgtttcccaacttcccgtaactaccgttaacgtcgggaacggccggggtcgttcgggaccgaacggggccgaaccgaattacggctgnnnnnngnnnnnnnnnnnnnnnnnnnnnnnnnn

SEQ ID NO: 61729 - DNA, 522 bp, Homo sapiens
  misc_feature: GYAE6OF01A5GS4.37.62.F07.1.454.CMB.1.raw
  modified_base (489)..(489): a, c, t, g, unknown or other
  misc_feature (489)..(489): n is a, c, g, or t
  modified_base (492)..(522): a, c, t, g, unknown or other
  misc_feature (492)..(522): n is a, c, g, or t
tcagtagtgtagatcacgaccggtgctcgatttagtagtcgcataaagggaagggactggagtgggtctcaggtattggtggcagtggtgagaccacatactacgcagactccgtgaaggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtcctcctcacgcctccaccgaacgggcccctatccgggtccttccccctggcccgcccctgcctccaggacgccacctccgagacgcacacgccggccccgtggggcctggtcccgtgggtcaaacgggtaccttacttcccgacttctaaccgaccttacgtggacgcggggtcctagggccaacgggcgcaagtacgctnacnnnnnnnnnnnnnnnnnnnnnnnnnnnnnnn

SEQ ID NO: 61730 - DNA, 459 bp, Homo sapiens
  misc_feature: GYAE6OF01CZS5W.37.62.F07.1.454.CMB.1.raw
  modified_base (327)..(327): a, c, t, g, unknown or other
  misc_feature (327)..(327): n is a, c, g, or t
  modified_base (422)..(422): a, c, t, g, unknown or other
  misc_feature (422)..(422): n is a, c, g, or t
  modified_base (448)..(459): a, c, t, g, unknown or other
  misc_feature (448)..(459): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggccaccctggtcactgtctcctcagcctcaccaaggcccatcggtcttccccnggcgccctgctccaggacgcacctccgagacgcacgaggccggccctggggcctgccctggtccaaaggtacctacttccattcctacactaacngagcgggctggccaaggcgcagtagnnnnnnnnnnnn

SEQ ID NO: 61731 - DNA, 558 bp, Homo sapiens
  misc_feature: GYAE6OF01AFCYK.37.62.F07.1.454.CMB.1.raw
  modified_base (531)..(558): a, c, t, g, unknown or other
  misc_feature (531)..(558): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccgaacgggcccagtccggtccttcccccgtggccgccctgcctccgagggacgccacccgtccgaagacgccaacacggccggcccgtggggcctcggacccgttgggtaccaaacgggtaccttacccgttacccaacttaccctaacctaacctttaaccgtacgggaacgggtccgggggacctcggggaccgaaacggggtccgaaccgaacgtagcgannnnnnnnnnnnnnnnnnnnnnnnnnnn

SEQ ID NO: 61732 - DNA, 508 bp, Homo sapiens
  misc_feature: GYAE6OF01CUDP3.37.62.F07.1.454.CMB.1.raw
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (466)..(466): a, c, t, g, unknown or other
  misc_feature (466)..(466): n is a, c, g, or t
  modified_base (481)..(481): a, c, t, g, unknown or other
  misc_feature (481)..(481): n is a, c, g, or t
  modified_base (491)..(508): a, c, t, g, unknown or other
  misc_feature (491)..(508): n is a, c, g, or t
tcagtagtgtagatcacgaccggtgctcgatttagtagtcgcataaaagggaagggactggagtgggtctcaggtattggtggcagtggtgagaccacatactacgcagactccgtgaagggccggttcaccatctccagagacaattccaagaacaccctgtctctgcaaatgaaacaacctgagagccgaggacacggccctatattactgtaacgaaaatggcctaacggatatgactactagtgggactggtacttcgatctcgtggggccgtggcacccgtggtcactgtcctcctcacgcctcccaaccgaacgggcccaacgttccggttccctttcccccgngggcccgccccttacgtccnccgaaggacgccacctccggaagacgccacgaggcccggcccgtcgggcttcgccgtgtacgaacggctactccactctacactacgtgaggcggngtcggacgaaggccncaagtagacnnnnnnnnnnnnnnnnnn

SEQ ID NO: 61733 - DNA, 455 bp, Homo sapiens
  misc_feature: GYAE6OF01AWUB2.37.62.F07.1.454.CMB.1.raw
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (432)..(455): a, c, t, g, unknown or other
  misc_feature (432)..(455): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcgtctcccctggcgccctgctccaggacgcaccgtccgagagcacagcggcctgggctgcctggtcaggctacttccatcacactatgagcgggctggacaacggcgnacgtagnannnnnnnnnnnnnnnnnnnnnnnn

SEQ ID NO: 61734 - DNA, 550 bp, Homo sapiens
  misc_feature: GYAE6OF01DHVSN.37.62.F07.1.454.CMB.1.raw
  modified_base (518)..(518): a, c, t, g, unknown or other
  misc_feature (518)..(518): n is a, c, g, or t
  modified_base (520)..(550): a, c, t, g, unknown or other
  misc_feature (520)..(550): n is a, c, g, or t
tcagtagtgtagatcacgaccggtgctcgatttagtagtcgcataaagggaaagggactagagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagccctccaccaagggcccatccggtccttccccctggccgccctgcctccgaggacgccaccgtccgagagccacgacggccggccccgtggggcctcggcccgttgggtaccgaaacgggtaccttaacccgtttccccaagttccctaaccaaccgttaccgtacgggaacgggtccggggtacgttggggacccgaaacggggccgaccaagtacggnannnnnnnnnnnnnnnnnnnnnnnnnnnnnnn

SEQ ID NO: 61735 - DNA, 490 bp, Homo sapiens
  misc_feature: GYAE6OF01EW8OU.37.62.F07.1.454.CMB.1.raw
  modified_base (327)..(327): a, c, t, g, unknown or other
  misc_feature (327)..(327): n is a, c, g, or t
  modified_base (355)..(355): a, c, t, g, unknown or other
  misc_feature (355)..(355): n is a, c, g, or t
  modified_base (460)..(460): a, c, t, g, unknown or other
  misc_feature (460)..(460): n is a, c, g, or t
  modified_base (463)..(466): a, c, t, g, unknown or other
  misc_feature (463)..(466): n is a, c, g, or t
  modified_base (468)..(490): a, c, t, g, unknown or other
  misc_feature (468)..(490): n is a, c, g, or t
tcagtagtgtagatcacgaccggtgctcgatttagtagtcgcataaagggaaagggactggagtgggtctcaggtattggtggcagtggtgagaccacatactacgcagactccgtgaaggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctctcagcctccaccaagggcccatccggtcttccccnggcgccctgctccaggcgcacctccganagcacgacgcggccctgggcctgcccgtggtcaagggtaccttacgttccaatcctaacactacgtggaaggtcgggactgggaccaacgggtcgactagtaggncgnnnntnnnnnnnnnnnnnnnnnnnnnnn

SEQ ID NO: 61736 - DNA, 595 bp, Homo sapiens
  misc_feature: GYAE6OF01D7P4Z.37.62.F07.1.454.CMB.1.raw
  modified_base (304)..(304): a, c, t, g, unknown or other
  misc_feature (304)..(304): n is a, c, g, or t
  modified_base (563)..(563): a, c, t, g, unknown or other
  misc_feature (563)..(563): n is a, c, g, or t
  modified_base (567)..(595): a, c, t, g, unknown or other
  misc_feature (567)..(595): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaaccaccctgtctctgcaaatgaacaacctgagagccgaggacacggccctatattactgtgtgaagggcctctacgtcccttatgcagcgctggtcctggtactttgacgacgtggggccagggaccctggtaccaccgtctcctcgacnccctccaccgaacgggccctaacgttccgggttacccctttcccccgtcgggccccgtcccctcggtcctacccgacgggtaaccgtcccaacccgttacccggaaggaccgaccaaccgtacggcccgggtcccgttcggggcctaccggcccgttacggggtacgaaacgggtacccttacccgtacctactttaccctaacctacttaccgtcgggaaccggtccgggtacgtcgggacgaacgggcgtacacgtnacgnnnnnnnnnnnnnnnnnnnnnnnnnnnnn

SEQ ID NO: 61737 - DNA, 445 bp, Homo sapiens
  misc_feature: GYAE6OF01CFA0F.37.62.F07.1.454.CMB.1.raw
  modified_base (434)..(434): a, c, t, g, unknown or other
  misc_feature (434)..(434): n is a, c, g, or t
  modified_base (439)..(445): a, c, t, g, unknown or other
  misc_feature (439)..(445): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccgaagggccccatccggtccttccccctggccgcccctgctccaggacgcacctccgagagcacagccggcctgggctgccctggtcaaggtactactccatcctacactactgagcggctggcaggcncatgnnnnnnn

SEQ ID NO: 61738 - DNA, 498 bp, Homo sapiens
  misc_feature: GYAE6OF01DMQ4X.37.62.F07.1.454.CMB.1.raw
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (476)..(476): a, c, t, g, unknown or other
  misc_feature (476)..(476): n is a, c, g, or t
  modified_base (478)..(498): a, c, t, g, unknown or other
  misc_feature (478)..(498): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctgtggggccgtggccacccgtggtcactgtctcctcacgcctccaccgaacggccctagtccgtccttccccgtggccnccctgcctccgaggcnccacctcgagacgcacgngcccggccgtggctcgccgtggacgaacggtacctacttccagtcctaacaccgtacgtcgggacggccggtacgtcgggtacgacgggcctacagtacgnannnnnnnnnnnnnnnnnnnnn

SEQ ID NO: 61739 - DNA, 558 bp, Homo sapiens
  misc_feature: GYAE6OF01CX5KJ.37.62.F07.1.454.CMB.1.raw
  modified_base (217)..(217): a, c, t, g, unknown or other
  misc_feature (217)..(217): n is a, c, g, or t
  modified_base (493)..(493): a, c, t, g, unknown or other
  misc_feature (493)..(493): n is a, c, g, or t
  modified_base (523)..(523): a, c, t, g, unknown or other
  misc_feature (523)..(523): n is a, c, g, or t
  modified_base (525)..(542): a, c, t, g, unknown or other
  misc_feature (525)..(542): n is a, c, g, or t
  modified_base (544)..(558): a, c, t, g, unknown or other
  misc_feature (544)..(558): n is a, c, g, or t
tcagtagtgtagatcacgaccggtgctcgatttagtagtcgcataaaagggaaagggactggaggtgggtctcaggtattggtggcagtggtgagaccacatactacgcagactccgtgaagggccggttcaccatctccagagacaattccaaagaacaccctgtctctgacaaaatgaaacaacctgagagccgaggacacggccctatattacngtaacgaaaatcggactaacggatatacgactaactagttgggactagggtacttacgattcgtcgtggggcgtcggctaccctggtcactgtctacctacacggacctacccaacgaacggccatccggtcctccccgtgcctacctgacctacaacgagccaccgtcgtcggggacaaggacgccggaccgtggcgtacgtccgtaggtaaccgaaaggtaccttaccttaccgacttaccctaactaacctaccgtagggtacgaacccgggntacgggaacgaacggacgactaagtacganannnnnnnnnnnnnnnnnnannnnnnnnnnnnnnn

SEQ ID NO: 61740 - DNA, 437 bp, Homo sapiens
  misc_feature: GYAE6OF01EEJLL.37.62.F07.1.454.CMB.1.raw
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (427)..(437): a, c, t, g, unknown or other
  misc_feature (427)..(437): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacacccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccatcggtcttccccctgcgccctgctcagngcacctcgagncacagcgcctgggctgcctggcaaggctacttccatctacactactgagcgggctggcaaggcgacatagcnnnnnnnnnnn

SEQ ID NO: 61741 - DNA, 544 bp, Homo sapiens
  misc_feature: GYAE6OF01CRZA7.37.62.F07.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (511)..(511): a, c, t, g, unknown or other
  misc_feature (511)..(511): n is a, c, g, or t
  modified_base (516)..(544): a, c, t, g, unknown or other
  misc_feature (516)..(544): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggacctacggatatgaactactattgggactggtacttcgatctcgtgggggccgtggcaccctggtctactgtctcctcngccctccaccgaagggcccagtccggtcccttcccccgnggccgccctgcctccgaggacgccacccgtccgaganccacgacggccggtcccgtcgggctcggcctttcgggtaccaacgggtaccttaccttaccacttaccctaactacctaacgtgggacggccgggcgttacgggcgaacggggcccgactaacgtaggcagngtacnnnnnnnnnnnnnnnnnnnnnnnnnnnnn

SEQ ID NO: 61742 - DNA, 463 bp, Homo sapiens
  misc_feature: GYAE6OF01BZDV0.37.62.F07.1.454.CMB.1.raw
  modified_base (445)..(445): a, c, t, g, unknown or other
  misc_feature (445)..(445): n is a, c, g, or t
  modified_base (450)..(463): a, c, t, g, unknown or other
  misc_feature (450)..(463): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaacgccaagaactccgtgcatctgcaaatgaacagtctgagagccgaggacacggctatttatactgcgcgagagaaggactgggcgtttcgactacgtggggccagggaaccctggtccaccgtctcctcacgcctccaccgaacgggcccagtccggtccttccccccgtgggccgcccctgcctccgagggacgccaccctccggagacggccacgacgccggcccctggggcctggccctagggtccaacggacttaccttccatcctacactactgacgcgggctggacaaggcanatagnnnnnnnnnnnnnn

SEQ ID NO: 61743 - DNA, 565 bp, Homo sapiens
  misc_feature: GYAE6OF01D0CUN.37.62.F07.1.454.CMB.1.raw
  modified_base (392)..(392): a, c, t, g, unknown or other
  misc_feature (392)..(392): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (532)..(533): a, c, t, g, unknown or other
  misc_feature (532)..(533): n is a, c, g, or t
  modified_base (535)..(538): a, c, t, g, unknown or other
  misc_feature (535)..(538): n is a, c, g, or t
  modified_base (540)..(540): a, c, t, g, unknown or other
  misc_feature (540)..(540): n is a, c, g, or t
  modified_base (542)..(544): a, c, t, g, unknown or other
  misc_feature (542)..(544): n is a, c, g, or t
  modified_base (546)..(548): a, c, t, g, unknown or other
  misc_feature (546)..(548): n is a, c, g, or t
  modified_base (551)..(554): a, c, t, g, unknown or other
  misc_feature (551)..(554): n is a, c, g, or t
  modified_base (556)..(557): a, c, t, g, unknown or other
  misc_feature (556)..(557): n is a, c, g, or t
  modified_base (559)..(565): a, c, t, g, unknown or other
  misc_feature (559)..(565): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgacaaatgaacaacctgagagccgaggacacggcctatattactgtaacgaaaatggcctaacggatatgactactagttgggactggtacttcgatcgtcgtggggcccgttggcctacccgtggtcctacgtgtccgtcctcgagccctccgaaccgaaagggcccagttccggtcccttccccgtggccgccctgccgtccgaggtacgccaccgtccgganacgcacgcggcgcccgtgggctcgccgtcggtacaacggaccttacttccgaacttcctaaacctacgtacgtacgggacggtcgggacgttacgggaccgtaacggggccgtaactaacgtaagctcganctacgnacnncnnnncncnnncnnngcnnnncnncnnnnnnn

SEQ ID NO: 61744 - DNA, 600 bp, Homo sapiens
  misc_feature: GYAE6OF01DZ0AC.37.62.F07.1.454.CMB.1.raw
  modified_base (248)..(248): a, c, t, g, unknown or other
  misc_feature (248)..(248): n is a, c, g, or t
  modified_base (557)..(557): a, c, t, g, unknown or other
  misc_feature (557)..(557): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(581): a, c, t, g, unknown or other
  misc_feature (569)..(581): n is a, c, g, or t
  modified_base (583)..(600): a, c, t, g, unknown or other
  misc_feature (583)..(600): n is a, c, g, or t
tcagtagtgtagatcacgaccggtgctcgatttagtagtcgcataaagggaaagggactggagtgggtctcaggtattgggtggcagtggtgagaccacatactacgcagactccgtgaagggccggttcaccatctccagagacaattccaaagaacaccctgtctctgacaaatgaacaacctgagagccgaggacacggccctatattactgtgcgagagatcaagacggataatagcgagcgancttcagacgtacgtgggacccaaccggtaacccgtggtaccctaaccgtcctcctacgaacgccctaccgaaccgaacgggccctacgttccggtcccttcccccgtgtccctacccctccgttaaccgaacgtaccggaccctaccggttcccggcggggaccaccgaacggtcccgggcccggttcgggcgtttccggccgttagggtaccgtaaacgggtaccttaaccgttacctacttaccctaccgtaacgtacggtacgacgggccgggtacgtagggacgaacggcgtaaccgtaaggttngacgtgnacncnnnnnnnnnnnnngnnnnnnnnnnnnnnnnnn

SEQ ID NO: 61745 - DNA, 508 bp, Homo sapiens
  misc_feature: GYAE6OF01DQS9J.37.62.F07.1.454.CMB.1.raw
  modified_base (493)..(508): a, c, t, g, unknown or other
  misc_feature (493)..(508): n is a, c, g, or t
tcagtagtgtagatcacgaccggtgctcgatttagtagtcgcataaaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctaggatatgactactatgggactggtactcgatctgtcggggccgtggccacccgtggtcacctgtcctcctcacgcctccaccgaacgggcccatccggtcccttcccccgtgggccgtccctgtcctcccgaggacgtccaacccgtccgacgacgacacgacggcccggcccgtcggggcctcggccgtaggtacgaacggtacctacttccactccgtaactactacgtggacggcggtctagggcaacgggccgacagtagnnnnnnnnnnnnnnnn

SEQ ID NO: 61746 - DNA, 428 bp, Homo sapiens
  misc_feature: GYAE6OF01BKOYP.37.62.F07.1.454.CMB.1.raw
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (419)..(428): a, c, t, g, unknown or other
  misc_feature (419)..(428): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtgggccgtggcaccctggtcactgtctcctcagcctcaccaagggcccatcggtctcccctgccgcctgctcagancactcgangcacngcgccctgggctgcctggtcaaggactactcatctacactacngagcgggctggacaggcncatgnnnnnnnnnn

SEQ ID NO: 61747 - DNA, 476 bp, Homo sapiens
  misc_feature: GYAE6OF01A17TM.37.62.F07.1.454.CMB.1.raw
  modified_base (248)..(248): a, c, t, g, unknown or other
  misc_feature (248)..(248): n is a, c, g, or t
  modified_base (355)..(355): a, c, t, g, unknown or other
  misc_feature (355)..(355): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
  modified_base (447)..(476): a, c, t, g, unknown or other
  misc_feature (447)..(476): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaatacggtctatctggaaatgaacagcctagagagcccgaggacacggccctctattactgtgcgaagagatcagacggtatatagcagcagctcngactactggggccacggaaccctggtcaccgtctcctcagcctcaccaaggcccatccggtcctcccctgcctaccctcctaccaagacgcctccactcggggcacncgcggccctggctcgctggtccaaggtcctactccatactacacgttcaggccgtcgggctcgggcaacgggccgnaactaggccagtcngnnnnnnnnnnnnnnnnnnnnnnnnnnnnnn

SEQ ID NO: 61748 - DNA, 510 bp, Homo sapiens
  misc_feature: GYAE6OF01BDLG7.37.62.F07.1.454.CMB.1.raw
  modified_base (473)..(473): a, c, t, g, unknown or other
  misc_feature (473)..(473): n is a, c, g, or t
  modified_base (480)..(481): a, c, t, g, unknown or other
  misc_feature (480)..(481): n is a, c, g, or t
  modified_base (484)..(510): a, c, t, g, unknown or other
  misc_feature (484)..(510): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgcacgaaaatggcctacggatatgactactattgggactggtacttcgatctctggggccgtggcaccctggtcactgtctcctcagcccccaccaacgggcccagtccggtccttcccccgtggccgcccctgcctccgaggacgccaccctccgaagacgccacacggccggtccccgtggggcctcggcccgtgggtaccaaggaccttaccttccagttcctaacaccgtactcggacgccggggctgggcaagggcncagtagnngcnnnnnnnnnnnnnnnnnnnnnnnnnnn

SEQ ID NO: 61749 - DNA, 450 bp, Homo sapiens
  misc_feature: GYAE6OF01BPP12.37.62.F07.1.454.CMB.1.raw
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (437)..(450): a, c, t, g, unknown or other
  misc_feature (437)..(450): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggccaccctggtcactgtctcctcagccctccaccaaggcccatccggtcttcccctggccgccctgcctccaggacncacctccganagcacagcgccctgggctgcctggtcaaggctacttccatcctacnctactgaggcgggntggcaagggcncagtnnnnnnnnnnnnnn

SEQ ID NO: 61750 - DNA, 456 bp, Homo sapiens
  misc_feature: GYAE6OF01CP41Q.37.62.F07.1.454.CMB.1.raw
  modified_base (263)..(263): a, c, t, g, unknown or other
  misc_feature (263)..(263): n is a, c, g, or t
  modified_base (335)..(335): a, c, t, g, unknown or other
  misc_feature (335)..(335): n is a, c, g, or t
  modified_base (440)..(440): a, c, t, g, unknown or other
  misc_feature (440)..(440): n is a, c, g, or t
  modified_base (445)..(456): a, c, t, g, unknown or other
  misc_feature (445)..(456): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctntggggccgttggcaccctggtcactgtctcctcagcctccaccaaggggcccatcggtcttccccctggccnccctgctccaggagccacctccgagacggcacgagccggcccgtgggctgccctgggtcaagggactacttccatctacactactgagcgggctggcaagggctnatagnnnnnnnnnnnn

SEQ ID NO: 61751 - DNA, 945 bp, Homo sapiens
  misc_feature: GYAE6OF01BJXFG.37.62.F07.1.454.CMB.1.raw
  modified_base (184)..(184): a, c, t, g, unknown or other
  misc_feature (184)..(184): n is a, c, g, or t
tcagtagtgtagatcacgaccggtgctcgatttagtagtcgcataaaggggggtccctgagactctccgtgtgcagcttcacggattcagctttagcagctacgccatgagctgggtccgccaggctccgagggtaagggctggagtgggtctcaggtattacgtggtagtaggtaactaccgnatactacgcagactccgtgaccgggtccggttcaccgttctccagagactaattccaagaacttacggtctatcgtaggaaatgaacacgtcctgagacgccgaggaccaccggcccctatactttaccgtggtcgacgaagagtactaccgaaggacgggtaagttacgaagcgacgcgacgtcttcgtacgtacccgttacgggtccggggaacccgtaacccgggtaccccgtaggtaccccgtaacccgttcccttacccgtctacccggtccccgtaacccctaacccgggaaaccccggtccccgtaaccggtttccccggtttacccccccgtttccccccggttaccgggtacccccctaccccccttaccccgttaaccccgtaaccggacccggtaccccgttaaccccggttacccgggggttccggggggaacccctacccgggtaaccccggttcccccgggggtacccccgggttccggggggttacccgttaccccggggttcccccgggttttaaccgggggttaccccggtaaaaacccggggtttaaccccgtttttaaacccctttacccccgtttaaaccgttaccccgttaaaccccggttaacccccgttaccgggtttaaaccgggaacccgggggttaccccggggttaccggggttaccggggaaacccgggttaaacccccgggggtacggaaaccccgtttaaacgggttccgaaccggttaccacgtcgcgcg

SEQ ID NO: 61752 - DNA, 544 bp, Homo sapiens
  misc_feature: GYAE6OF01DPZGS.37.62.F07.1.454.CMB.1.raw
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (515)..(544): a, c, t, g, unknown or other
  misc_feature (515)..(544): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgacaaatgaacaacctgagagccgaggacacggcctatattacngtacgaaaatggcctaaggatangaacttactagttgggactggtacttcgatctcgtggggccgtggcctaccgtggtcacttgtcctcctcacgcctacccaaccgaacgggccccagttccggtccctttcccccgnggccgccctgcctccgaggacncaccctcgaagcncacgtacggccggccctggggtcctggtcccgtacgggtacaaacgggtccttaccgttaccactccgttaaacacgtacgtgggaacggtccgggcgtaggaccgaagggccgtactacgtagcagannnnnnnnnnnnnnnnnnnnnnnnnnnnnn

SEQ ID NO: 61753 - DNA, 617 bp, Homo sapiens
  misc_feature: GYAE6OF01CUHO9.37.62.F07.1.454.CMB.1.raw
  modified_base (577)..(577): a, c, t, g, unknown or other
  misc_feature (577)..(577): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (596)..(601): a, c, t, g, unknown or other
  misc_feature (596)..(601): n is a, c, g, or t
  modified_base (604)..(607): a, c, t, g, unknown or other
  misc_feature (604)..(607): n is a, c, g, or t
  modified_base (609)..(617): a, c, t, g, unknown or other
  misc_feature (609)..(617): n is a, c, g, or t
tcagtagtgtagatcacgaccggtgctcgatttagtagtcgcataaagggaaagggactggagtgggtctcaggtattggttggcagtggtgagaccacatactacgcagactccgtgaagggccggttcaccatctccagagacaattccaagaacaccctgtctctgcaaatgaacaacctgagagccgaggacacggcctatatactgtaacgaaaatggcctacggatatgaactactagttgggacttggtacttgatcgtcgtgggccgtgccacctggtcactgtcctcctcacgcctaccaaccgaacggtcccacgttccggttacccttcccccgtggccgtaccccttgacccttaccgacggtacgccctaccgttccggagacgaccaaacgccggcccgggtcccgtcggggaccttccgggtcccgttacgggttaaccaaagggttaaccctaccgtttacccgtaacttcccgttaaacctacgttaaccggtacggggaacgtcccggggtacgtaccggggacaaacgggggcctaacgtaacgttaggctacagtcnctagcgtacanacncnacnnnnnnagnnnncnnnnnnnnn

SEQ ID NO: 61754 - DNA, 482 bp, Homo sapiens
  misc_feature: GYAE6OF01C3P27.37.62.F07.1.454.CMB.1.raw
  modified_base (179)..(179): a, c, t, g, unknown or other
  misc_feature (179)..(179): n is a, c, g, or t
  modified_base (215)..(215): a, c, t, g, unknown or other
  misc_feature (215)..(215): n is a, c, g, or t
  modified_base (332)..(332): a, c, t, g, unknown or other
  misc_feature (332)..(332): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (459)..(482): a, c, t, g, unknown or other
  misc_feature (459)..(482): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaacagcacgctgtatttgcacatgaacngcctgagagccgaggacacggccatatatttattgngacgtaaactttccgttttagacttggttacttactcccctagtcgaccacgtcgggaccaggaaccctggtcaccgtctcctcacgcctaccacgacggccagtccgtctccccgngcccacctcctcaagcgcaccgtcgcggggcacgacggccgccgtcggctcgcgtgacgaacggtacctacgttcactactacacttacncgtaggcggtacgnggaacgaggcgacctaagtcgannnnnnnnnnnnnnnnnnnnnnnn

SEQ ID NO: 61755 - DNA, 505 bp, Homo sapiens
  misc_feature: GYAE6OF01DZCTF.37.62.F07.1.454.CMB.1.raw
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
  modified_base (484)..(505): a, c, t, g, unknown or other
  misc_feature (484)..(505): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagcgaggacacggccctatattactgtaacgaaaatggcctacggatatgactactagttgggactggtacttcgattctcgtgggggccgtgggccacccgttggtccactgtcctcctcagcccctacaccgaacgggcccagtccggttccttcccccgnggccncccttagcctccgaggacncaccctcgagcgcacncggccggccctgggcctgccgtaggtcgaacggtacttaccgttcattacctacacgtactaggacggtcgggctcgggcaacggcgctaagtcgnnnnnnnnnnnnnnnnnnnnnn

SEQ ID NO: 61756 - DNA, 598 bp, Homo sapiens
  misc_feature: GYAE6OF01A8UNB.37.62.F07.1.454.CMB.1.raw
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (569)..(570): a, c, t, g, unknown or other
  misc_feature (569)..(570): n is a, c, g, or t
  modified_base (572)..(598): a, c, t, g, unknown or other
  misc_feature (572)..(598): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctcgtggggccgtggcacccgtggtcactgtcctcctcgacgccctaccaccgaacgggccctacgttccggttccctttccccccgtgggcccgtccccttcgtcccgtcccgaacgggacgtcccgaacccgttccggaagaccggaccgaaccggaccgggcccgggtccccggtcggggccttcggtcccgttgggtaccgaaacgggtaccttacccgtttacccaacgttacccttaacaccgttacgtacggacgggccgggcttacgggacgtaacggccgtacaagtcgngcancgnncnnnnnnnnnnnnnnnnnnnnnnnnnnn

SEQ ID NO: 61757 - DNA, 448 bp, Homo sapiens
  misc_feature: GYAE6OF01AL36T.37.62.F07.1.454.CMB.1.raw
  modified_base (438)..(448): a, c, t, g, unknown or other
  misc_feature (438)..(448): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtccttccccctggccgccctgcctccgaggacgcacctccgagacgcacagcggccctgggctcgcctggtcaaggactacttccatctacactactgagcggctggcaaggcgcatgnnnnnnnnnnn

SEQ ID NO: 61758 - DNA, 546 bp, Homo sapiens
  misc_feature: GYAE6OF01DT9EY.37.62.F07.1.454.CMB.1.raw
  modified_base (379)..(379): a, c, t, g, unknown or other
  misc_feature (379)..(379): n is a, c, g, or t
  modified_base (469)..(469): a, c, t, g, unknown or other
  misc_feature (469)..(469): n is a, c, g, or t
  modified_base (516)..(546): a, c, t, g, unknown or other
  misc_feature (516)..(546): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtactcgatctcgtgggccgtggccacccgtggtcactgtctcctcacgccctccaaccgaacgggcccagttccggtcccttccccccgtggcccgtccctgcctccgaggacgccaccctccgagngccacgcggccggtccctggggccttcggcccgttgggtaccgaaacggtaccttaacctttcccaattccctaaccgtaaccgttacgngggaaccggtccggggtcgtacgggaccgaacgggcgacaagtcgcnnnnnnnnnnnnnnnnnnnnnnnnnnnnnnn

SEQ ID NO: 61759 - DNA, 611 bp, Homo sapiens
  misc_feature: GYAE6OF01D7O51.37.62.F07.1.454.CMB.1.raw
  modified_base (210)..(210): a, c, t, g, unknown or other
  misc_feature (210)..(210): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (592)..(593): a, c, t, g, unknown or other
  misc_feature (592)..(593): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattacngtaacgaaaatggcctacggatatgactactattggactggtacttcgatctcgtggggccgtggcacccgtggtccactgtctcctcacgccctccaaccgaacgggcccagttccggttcctttcccccgtggccgtccctgcctccgaggacgccacccgtccggagacgccgaacacggccgggtacccgtggggtcctacgggcccgttagggtacccaaagggtaccctttaaccgtttacccgaactttacccgtaaacctaaccgttacgttcggggaacggccgggggtaccttaggggacccgtaaacgggggcccgtacgtaagttacggnagngncgcgngcgcgagtagnagacgngnngngcgngcgnngncnncgcncnncngngn

SEQ ID NO: 61760 - DNA, 511 bp, Homo sapiens
  misc_feature: GYAE6OF01BI7V8.37.62.F07.1.454.CMB.1.raw
  modified_base (487)..(511): a, c, t, g, unknown or other
  misc_feature (487)..(511): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccatcggtccttcccctggccgccctgcctccagggacgccacctccgagacgcacgcgccggccccgtgggcctcggcccgttgggtaccaaagggtaccttacttccaagttccctaaccacgttacgtggacggccgggctacggggaccaaggggccgacacgtaggctgnnnnnnnnnnnnnnnnnnnnnnnnn

SEQ ID NO: 61761 - DNA, 533 bp, Homo sapiens
  misc_feature: GYAE6OF01E3AFO.37.62.F07.1.454.CMB.1.raw
  modified_base (506)..(533): a, c, t, g, unknown or other
  misc_feature (506)..(533): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggccaccctggtcactgtctcctcacgcctccaccgaacgggccccagtccggtcctttcccccgtggcccgcccctgcctcccgaggacgccacccgtccgaagacgccacgacggccggcccggtgggcctcgcccgttggtacaacgggtaccttaccttaccaactccctaacaccttacgtcggacggccggggtctgggaccgaagggtccgaccgtaagtacgnnnnnnnnnnnnnnnnnnnnnnnnnnnn

SEQ ID NO: 61762 - DNA, 666 bp, Homo sapiens
  misc_feature: GYAE6OF01A4SYE.37.62.F07.1.454.CMB.1.raw
  modified_base (580)..(580): a, c, t, g, unknown or other
  misc_feature (580)..(580): n is a, c, g, or t
  modified_base (602)..(602): a, c, t, g, unknown or other
  misc_feature (602)..(602): n is a, c, g, or t
  modified_base (617)..(617): a, c, t, g, unknown or other
  misc_feature (617)..(617): n is a, c, g, or t
  modified_base (648)..(648): a, c, t, g, unknown or other
  misc_feature (648)..(648): n is a, c, g, or t
tcagtagtgtagatcacgaccggtgctcgatttagtagtcgcataaagggaaaggggacgtggagtgggtctcaggtattggtggcgagtggtgagaccacatactaccgcacgactccgttcgaaggccggttcaccatctccagagacaattccaagaacaccctgtctctgacaaatgaaccaacctgagagccgaggaccacggcctatagttactgtacgaaatcggcctaggatatgactactatagggactggtactttgatcgtcgagggtccgtggaccacccgtggtccacgttggtcctacctcgacgtccctccgaaccgaagggacccaagtccggtccttccccgtaggccgtccctggccttaccgagggactcgaacccgtccgtaacggacgaccgacgtacggccgggccccgttaggggtccttacggccccgttaggggtaccgtaaaaggggtcccctttaaaccgtttccgaaatttcccgtaaacgacctttaacggtggtaacgggtccggggtaccgttacgggaacccgaagggcccgtacgaactttaaggcnggttagacgcgaagtggaccgnggtagtaacgcgagngtcgcgcgacgtacgacgcgacgcgcgcgcncgtctctctctcgtcgtc

SEQ ID NO: 61763 - DNA, 532 bp, Homo sapiens
  misc_feature: GYAE6OF01ED9F2.37.62.F07.1.454.CMB.1.raw
  modified_base (274)..(274): a, c, t, g, unknown or other
  misc_feature (274)..(274): n is a, c, g, or t
  modified_base (472)..(472): a, c, t, g, unknown or other
  misc_feature (472)..(472): n is a, c, g, or t
  modified_base (501)..(532): a, c, t, g, unknown or other
  misc_feature (501)..(532): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattattgtgcgaaatggtggggggagtgggggctactcctggtcgttttgactacgtggggccaggggngccctggtcaccgtctcctcagcctcccaccgaacgggccccagtccgggtcctttcccccgtcgggcccgtccccgtcgcctcccgaggacgccaccctccggagaggccaacgaggcccggccccgtggggctcggcccgttgggtacaaacggtccttaccgttcccaatcctaacaccgtactggaggccgggngtcgggaccgaagggcgacgaagtaggtnnnnnnnnnnnnnnnnnnnnnnnnnnnnnnnn

SEQ ID NO: 61764 - DNA, 611 bp, Homo sapiens
  misc_feature: GYAE6OF01BOCLE.37.62.F07.1.454.CMB.1.raw
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
  modified_base (580)..(584): a, c, t, g, unknown or other
  misc_feature (580)..(584): n is a, c, g, or t
  modified_base (586)..(611): a, c, t, g, unknown or other
  misc_feature (586)..(611): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaacagcacgctgtatttgcacatgaacagcctgagagccgaggacacggccatatattattgtgacgtaaactttcctttgacttggttattactccctagtcgaccacggtgggccgacgggaaccctggtcaccgttctcctcacgccctaccaccgaacgggccctacgttccggtcccttcccccgtcggcccctacccccttaccctacccgtaacgaccggaccctacccgttcgggtccgggggacccaccggtaccgggccccggtccccggtcggggtcccgtcggtcccggttacgggtacccgtaaacggtaccctttaacccgttaccctaacgttccctaaaccgtaaccttacgtacgggacgggtccgggtacgtacgggaccgtaaacgggccgacgtaacgtaggntacncnnnnncnnnnnnnnnnnnnnnnnnnnnnnnnn

SEQ ID NO: 61765 - DNA, 485 bp, Homo sapiens
  misc_feature: GYAE6OF01D0NBL.37.62.F07.1.454.CMB.1.raw
  modified_base (471)..(485): a, c, t, g, unknown or other
  misc_feature (471)..(485): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgaggcgaggacacggccctatattactgtacgaaaatggcctacggatatgactactattgggactggtacttcgatctcgtggggccgttcggcaccctggtcactgttctcctcagcctccaccaacgggcccacgttccggtcctttcccccgtcggccgtccctcgctccaggcgccacctcgagacgcacacgtcggccgtggctcgccgtggtacgaaggtacctaccttcctacttctaccactacgtggacgcggggtctgggacgaacggtcacgtatagnnnnnnnnnnnnnnn

SEQ ID NO: 61766 - DNA, 480 bp, Homo sapiens
  misc_feature: GYAE6OF01BMDM3.37.62.F07.1.454.CMB.1.raw
  modified_base (351)..(351): a, c, t, g, unknown or other
  misc_feature (351)..(351): n is a, c, g, or t
  modified_base (454)..(480): a, c, t, g, unknown or other
  misc_feature (454)..(480): n is a, c, g, or t
tcagtagtgtagatcacgaccggtgctcgatttagtagtcgcataaagggaaagggactggagtgggtctcaggtattgggtggcagtggtgagaccacatactacgcagactccgtgaaggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtccttcccccgtggccgccctgcctccaggacnccacctccgagacgccacacggccggccctggggcctggccctggtcaaggactacgttccatccttacactatgagcgggctggcaaggccgtacagtagcnnnnnnnnnnnnnnnnnnnnnnnnnnn

SEQ ID NO: 61767 - DNA, 475 bp, Homo sapiens
  misc_feature: GYAE6OF01CR4QP.37.62.F07.1.454.CMB.1.raw
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (368)..(369): a, c, t, g, unknown or other
  misc_feature (368)..(369): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (454)..(475): a, c, t, g, unknown or other
  misc_feature (454)..(475): n is a, c, g, or t
tcagtagtgtagatcacgaccggtgctcgatttagtagtcgcataaaagggaagggactggagtgggtctcaggtattggtggcagtggtgagaccacatactacgcagactccgtgaagggccggttcaccatcctcagagacaattccaaagaacctaccctgtctctgacaaatgaacaacctgagacgccgaggacgaccgcctaatattactagtaaacgaaaagtcgtacctacggatatgaactactagttgggactaggttactnatcgtcgtgggccgtcgccactgtcactntctctcncncctccaaccgacggccagtccgttccctcccgngcccncncncncagcnccncncgnngacncgacgccgtcgtggcncgcgtgacgtagtacctacttcactcactactcgcggaggcggtagtcgacgcgtcgancgngcnnnnnnnnnnnnnnnnnnnnnn

SEQ ID NO: 61768 - DNA, 588 bp, Homo sapiens
  misc_feature: GYAE6OF01DCBGK.37.62.F07.1.454.CMB.1.raw
  modified_base (211)..(211): a, c, t, g, unknown or other
  misc_feature (211)..(211): n is a, c, g, or t
  modified_base (551)..(551): a, c, t, g, unknown or other
  misc_feature (551)..(551): n is a, c, g, or t
  modified_base (557)..(588): a, c, t, g, unknown or other
  misc_feature (557)..(588): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattacngtaacgaaaatggacctacggattatgactactatgggactggttactcgatctcgtggggccgtggccaccttggtcactgtctcctcacgtcctcccaaccgaacgggcccctagtccggttacccttccccccgtggcccgccccgtcgccttcccgaggaccgcctaaccgtccggaacgacgaccgaacgacggcccgggccccgtggggccttcggcccgttacgggtaccgaaacgggttaaccttacccgtttaccaactttccctaactaacccttacggtgggaaccgggtccggggtacgtacgggaccgtaaaggggcccgactaagnggtcannnnnnnnnnnnnnnnnnnnnnnnnnnnnnnn

SEQ ID NO: 61769 - DNA, 612 bp, Homo sapiens
  misc_feature: GYAE6OF01EG1CR.37.62.F07.1.454.CMB.1.raw
  modified_base (210)..(210): a, c, t, g, unknown or other
  misc_feature (210)..(210): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (579)..(581): a, c, t, g, unknown or other
  misc_feature (579)..(581): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (593)..(595): a, c, t, g, unknown or other
  misc_feature (593)..(595): n is a, c, g, or t
  modified_base (597)..(609): a, c, t, g, unknown or other
  misc_feature (597)..(609): n is a, c, g, or t
  modified_base (612)..(612): a, c, t, g, unknown or other
  misc_feature (612)..(612): n is a, c, g, or t
tcagtagtgtagatcacgaccggtgctcgatttagtagtcgcataaaagggaaaagggactggagtgggtctcaggtattggtggcagtggtgagaccacatactacgcagactccgtgaagggccgttcaccatctcagagacaattccaaagaacaccctgtctctgacaaatgaaccaactgagagccgagacacgcctatattacngtaacgaaatcggacctacggatagtgactaactagttggactggtactgatcgtcgtgggccgtgcctaccgtgtcactgtcctcctcgacgccctaccaccgaacggccctacgttccgtcccgtttcccccgggacccgtcccgtcgtacctccggaaggaccgccctacccgtcggaacgaccgaccaccggacggtccggacccggtcggtcctcggtccgtacgggttaaccgaaacggtttccttaacccgtttaccacgttaaccctacgtaaccgttacggtcgggtaaccgggtccgggtacggtaaccgggaaccggtaaccggccgtaaccgtagtaacggcnacgtncgtnagngnnngngcgangncgnnngnnnnnnnnnnnnngtn

SEQ ID NO: 61770 - DNA, 724 bp, Homo sapiens
  misc_feature: GYAE6OF01D3HH3.37.62.F07.1.454.CMB.1.raw
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
  modified_base (443)..(443): a, c, t, g, unknown or other
  misc_feature (443)..(443): n is a, c, g, or t
tcagtagtgtagatcacgaccggtgctcgatttagtagtcgcataaagggggggtccctgagactctcctgtgcagcttcaggattcagctttagcagctacgccatgagctgggtccgccaggctccaggggaagggactggagtgggtctcaggttattgggtggcaggtggtgacgtaccacagtacctacgcaagaccttcccggtaggaacgggtcccggttacaccgtatccgtaccagacgactaagttccaaagaaccncccgtagtctcagacaaatcgaactaaccgtgaacgngaccgaggacaccggaccttaagtattactaggtaacgaaaagtcggacctacggtatacgtacgtacctacttagttgggactggttaccttgattcgtcgtcggggccgtgccctaccgtggtcacgttcgctcctnaccgtcctaccgacgaccggccctacgttccgggtaccctacccccggtggaccctcccgtacggtccctaccggacggtcgtaacccgaccccgtccggtaacgcggtacccaacggtaccggcccggggtaccccgtggggtaccctcgggtacccgttaacggttacggtaaacccggtacctttaccgtccttaacgtcccgttaaaccgtacccgttacggtagggtcccggtacccgggtacgtacgggaacccgtaacgggccagtacgtacgg

SEQ ID NO: 61771 - DNA, 633 bp, Homo sapiens
  misc_feature: GYAE6OF01BTKHT.37.62.F07.1.454.CMB.1.raw
  modified_base (392)..(392): a, c, t, g, unknown or other
  misc_feature (392)..(392): n is a, c, g, or t
  modified_base (581)..(581): a, c, t, g, unknown or other
  misc_feature (581)..(581): n is a, c, g, or t
  modified_base (586)..(588): a, c, t, g, unknown or other
  misc_feature (586)..(588): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (602)..(602): a, c, t, g, unknown or other
  misc_feature (602)..(602): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(624): a, c, t, g, unknown or other
  misc_feature (620)..(624): n is a, c, g, or t
  modified_base (626)..(628): a, c, t, g, unknown or other
  misc_feature (626)..(628): n is a, c, g, or t
  modified_base (632)..(632): a, c, t, g, unknown or other
  misc_feature (632)..(632): n is a, c, g, or t
tcagtagtgtagatcacgaccggtgctcgatttagtagtcgcataaaagggaaagggactggagtgggtctcgaggtattggtggcagtggtgagaccacatactacgcagactccgtgaagggccggttcaccatctccagagacaattccaagaacaccctgtctctgcaaatgaacaacctgagagccgaggacacggcctatagttactggtacgaaaatggacctacggatatgactactagttgggactggtacttcgatctcgtcgggggccgtggcctacccgtgggttccacgttcgttccttccctaccacgtcccctacccaacccgaacggggcccctagttccggtcccttccccgtggcccgccctgcctccgaggcnccacccgtcggacgacgcgacgtacggccgtacccggtgggtcctacgggtcccgttagggttacccgaaacgggtaaccctttaaccgttacccgtaacgtttacccttaaacccgtaaccgttacgtacgggtaaaccgggtcccggggtacgtaccggggacgaaacgggtccgtactaaggtcgntgacnnncgcngnngngngcncgcntcgngngngngngnnnnntnnnctgnc

SEQ ID NO: 61772 - DNA, 447 bp, Homo sapiens
  misc_feature: GYAE6OF01BWZN3.37.62.F07.1.454.CMB.1.raw
  modified_base (437)..(447): a, c, t, g, unknown or other
  misc_feature (437)..(447): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccatccggtcttcccccgtggccgccctgcctccgaggacgcacctccgagagcacagccggccctgggctcgcctggtcaaggctactccatctacactactgagcgggctggcaggcgcatgnnnnnnnnnnn

SEQ ID NO: 61773 - DNA, 514 bp, Homo sapiens
  misc_feature: GYAE6OF01CR53F.37.62.F07.1.454.CMB.1.raw
  modified_base (451)..(451): a, c, t, g, unknown or other
  misc_feature (451)..(451): n is a, c, g, or t
  modified_base (484)..(484): a, c, t, g, unknown or other
  misc_feature (484)..(484): n is a, c, g, or t
  modified_base (489)..(514): a, c, t, g, unknown or other
  misc_feature (489)..(514): n is a, c, g, or t
tcagtagtgtagatcacgaccggtgctcgatttagtagtcgcataaaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatcggcctacggatatgactactagtgggacttggtacttcgattctcgtggggccgtggccacccgtggtcactcgtcctcctcgacgtcccctaccaaccgaacggggcccctagttccgggtccccttccccccgtgggcccgtccctcgcctaccgaggacgccacccgtccggagacgccacgacggccgccgtggctcgcgtggacagtcctactcacgtctacnctagcgacgcggctagggcaagggcacagtacntacgnnnnnnnnnnnnnnnnnnnnnnnnnn

SEQ ID NO: 61774 - DNA, 540 bp, Homo sapiens
  misc_feature: GYAE6OF01EAOS1.37.62.F07.1.454.CMB.1.raw
  modified_base (518)..(540): a, c, t, g, unknown or other
  misc_feature (518)..(540): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaaatgaacaacctgagagccgaggacacggccctatattactagtaacgaaaagtggacctacggattatgactaactagttcgggactggttacttgatcgtcgtggggccgtggccaccctggtcactcgtctcctcacgcccctccaaccgacgggcccctagtccggtcccttcccccgtggccgtcccctgcctccgaggacaccacccgtaccgagaccgcaacgacggcccggtacccgtgggcctcggcccgtggtaccgaacggtaccttaccttccacttaccgtaaccaccgtacgtggacgggcgggcgtagggaaccgacgggctacgagtagnnnnnnnnnnnnnnnnnnnnnnn

SEQ ID NO: 61775 - DNA, 547 bp, Homo sapiens
  misc_feature: GYAE6OF01CMDST.37.62.F07.1.454.CMB.1.raw
  modified_base (264)..(264): a, c, t, g, unknown or other
  misc_feature (264)..(264): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(528): a, c, t, g, unknown or other
  misc_feature (525)..(528): n is a, c, g, or t
  modified_base (530)..(531): a, c, t, g, unknown or other
  misc_feature (530)..(531): n is a, c, g, or t
  modified_base (533)..(545): a, c, t, g, unknown or other
  misc_feature (533)..(545): n is a, c, g, or t
  modified_base (547)..(547): a, c, t, g, unknown or other
  misc_feature (547)..(547): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctntggggccgtggccaccctggtcactgtcctcctcagccctccaccgacgggcccagtccggtccttcccccgnggccncccgtgcctccgaggcgccacctccggagacgccacgacgccggcccgtgggctcgccgttggaccgacggtacctacttccctaacgtcctaacgtaacctacgttacggaacggccggggtcgtcgggaccgaaggggcccgtacgaacgtaggcncgngtcntcgcncagcgtaangncnnnngnngnnnnnnnnnnnnngn

SEQ ID NO: 61776 - DNA, 628 bp, Homo sapiens
  misc_feature: GYAE6OF01A3Q7J.37.62.F07.1.454.CMB.1.raw
  modified_base (168)..(168): a, c, t, g, unknown or other
  misc_feature (168)..(168): n is a, c, g, or t
  modified_base (184)..(184): a, c, t, g, unknown or other
  misc_feature (184)..(184): n is a, c, g, or t
  modified_base (210)..(210): a, c, t, g, unknown or other
  misc_feature (210)..(210): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
tcagtagtgtagatcacgaccggtgctcgatttagtagtcgcataaagggaagggactggagtgggtctcaggtattggtggcagtggtgaggaccacatactacgcagactccgtgaagggccgttcaccatctccagagaccaagttccaagaacaccctgtctcngcaaatgaacactganagccgagacacggccctatacttacngtaacgaaatcggacctacggatatgactactagttggactggtacttgactcgtgtgggccgtgacgaccctggtaccacgtcgtacgttcctcacgcctaccaaccgtacgggaccctacgttacggtccttacccccgtggacccgtcccgtacggtcctaacccgagggaacgaccgtaacccgtcccggtaacgacggccaaaccgtacggccgggccccgttggggaccctggttacccctggggttaacccaaacgggtacctaaccttaccgtactaccttaacctaccgtactacggtacggaccggacgtacggacgaaccgggtcgaactaacgtacgatgacntacncgancganancgncagtcnanacgacgacgcacacgcgacacactacacacncngcgac

SEQ ID NO: 61777 - DNA, 624 bp, Homo sapiens
  misc_feature: GYAE6OF01DE641.37.62.F07.1.454.CMB.1.raw
  modified_base (569)..(569): a, c, t, g, unknown or other
  misc_feature (569)..(569): n is a, c, g, or t
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(616): a, c, t, g, unknown or other
  misc_feature (611)..(616): n is a, c, g, or t
  modified_base (618)..(624): a, c, t, g, unknown or other
  misc_feature (618)..(624): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctcagagacaattccaagaacaccctgtctctgacaaatgaacaacctgagagccgaggacacggccctatattactgtaacgaaaatcggcctaacggatatagactatagttggacttggtacttcgatctcgtcggggcgtggccaccgtggtcactgtcctctcgacgcctaccaccgaacggcctacgtccggtcccttccccgtggcccgtcccgtcgtcctccgacggacgccctaacccgtccgaaggaccgacgaacgtaccgggccggtccccgtcgggtccgtcggtcccgttcgggtaaccgaacgggttaaccctttaaccggttacctaaccttaacccttaacggtaacccgttaacgttcggggaaccgggtacccggggtcgttaacggggaaccaacgggtccgaacctaggttaanccggtangcgcgcncncgcgacactacnagcgcncncngngnnnnnncnnnnnnn

SEQ ID NO: 61778 - DNA, 573 bp, Homo sapiens
  misc_feature: GYAE6OF01E3KEO.37.62.F07.1.454.CMB.1.raw
  modified_base (360)..(360): a, c, t, g, unknown or other
  misc_feature (360)..(360): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (548)..(549): a, c, t, g, unknown or other
  misc_feature (548)..(549): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
tcagtagtgtagatcacgaccggtgctcgatttagtagtcgcataaagggtaaagggtacgtggagtgggtctcgaggttattggtggcagtggtgagaccacatactacgcagactccgttgaaggccggttcaccatctccagagacaattccaagaacaccctgtctctgcaaatcgaacaacctgagagccgaggacacggccctatattactgtacgaaaatggcctacggatatgactactattggactggtacttcgatctcgtgggccgtggccacccgtggtacactgtactcctcacgcctccaccaacggcccatccgtcttcccccgtagccgccctgcctccacggnccacctccgacgtcgcacaggccgaccctgggcctgtcccgtggtccgaaagggtcctaccgtttcacgtacctactaccgtaacgtacggaacgggccgggtcttacgggaacgtaaaccgggtccgtacctaaacgttacggagtcgtgacgcncgtagacngngagacgancncngctcacgcgnncgcncncncgtcncnnctctcgtc

SEQ ID NO: 61779 - DNA, 477 bp, Homo sapiens
  misc_feature: GYAE6OF01EAJ3E.37.62.F07.1.454.CMB.1.raw
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (434)..(435): a, c, t, g, unknown or other
  misc_feature (434)..(435): n is a, c, g, or t
  modified_base (438)..(439): a, c, t, g, unknown or other
  misc_feature (438)..(439): n is a, c, g, or t
  modified_base (441)..(442): a, c, t, g, unknown or other
  misc_feature (441)..(442): n is a, c, g, or t
  modified_base (445)..(477): a, c, t, g, unknown or other
  misc_feature (445)..(477): n is a, c, g, or t
tcagtagtgtagatcacgaccggtgctcgatttagtagtcgcataaagggaaagggactggagtgggtctcaggtattactggtagtggtaataccgcatactacgcagactccgtgaagggccggttcaccatctccagagacaattccaagaacacgctctatctgcaaatgaaacagcctagagagccgaagacacggccgtatattactgtgtagaaaggctgggggagtggggggactacgtggggccagggaaccctggtcaccgtcncctnagcctccaccaggcccagtccgtccttccccngccncccctcctacaagnccacgtcgtcgggggcacncggccgcccgtgggctgcctggtacgaacggacttacgtccatcctacactacgtggcggcgggctaggacgaaaggccgatatagnngannanntgnnnnnnnnnnnnnnnnnnnnnnnnnnnnnnnnn

SEQ ID NO: 61780 - DNA, 538 bp, Homo sapiens
  misc_feature: GYAE6OF01EYO6F.37.62.F07.1.454.CMB.1.raw
  modified_base (266)..(266): a, c, t, g, unknown or other
  misc_feature (266)..(266): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (493)..(493): a, c, t, g, unknown or other
  misc_feature (493)..(493): n is a, c, g, or t
  modified_base (518)..(518): a, c, t, g, unknown or other
  misc_feature (518)..(518): n is a, c, g, or t
  modified_base (520)..(538): a, c, t, g, unknown or other
  misc_feature (520)..(538): n is a, c, g, or t
tcagtagtgtagatcacgaccggtgctcgatttagtagtcgcataaaagggaagggactggagtgggtctcaggtattggtggcagtggtgagaccacatactacgcagactccgtgaaggccggttcaccatctcagagacaattccaagaaccaccctgtctctgacaaatgaacaacctgagagccgagacacggccctatattactgtaacgaaaatggcctaaggatatgacttactagtgggactgtactcgatcgtcgngggccgtgcctaccgtggtcactcgtctcctcacgtcctccaccgacggcctagtcccgtcctccccgngccnccctgcctcgagacgccgacctcggagcncacgcgccggcccgtggcctcggtcccttggaccgtaaggtacccttaccgttaccacttacctaacctacgtaacgtgggacgggtaccggtagtcggaacgacgggtaccggaactacgagtncagctagctgattggctagcagtcngnnnnnnnnnnnnnnnnnnn

SEQ ID NO: 61781 - DNA, 526 bp, Homo sapiens
  misc_feature: GYAE6OF01CDHH0.37.62.F07.1.454.CMB.1.raw
  modified_base (466)..(466): a, c, t, g, unknown or other
  misc_feature (466)..(466): n is a, c, g, or t
  modified_base (505)..(526): a, c, t, g, unknown or other
  misc_feature (505)..(526): n is a, c, g, or t
tcagtagtgtagatcacgaccggtgctcgatttagtagtcgcataaagggaaagggactggagtgggtctcaggtattggtggcagtggtgagacaacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtgcgacctggtctactgtcctcctcagtccctccaccgaacgggccctagtccggttccgttccccctaggcccgccctcgtcctccgtaggcgacccgacctcccggagacgcacgacgccgggcccgtcggccgtcgccgtggtaccgaaggtaccttaccgttccataccgtaccctacgtacgtacggnggccggggtctcgggacgtaacggcgtaccaagtagacnnnnnnnnnnnnnnnnnnnnnn

SEQ ID NO: 61782 - DNA, 538 bp, Homo sapiens
  misc_feature: GYAE6OF01A0UFI.37.62.F07.1.454.CMB.1.raw
  modified_base (516)..(538): a, c, t, g, unknown or other
  misc_feature (516)..(538): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggccaccctggtcactgtcctcctcacgccctaccaccgaacgggcccagttccggtcccttcccccgtggcccgtccctgacctccgaggacgccaccctccggagacgccaacgtaccggccggtcccgtcgggcctcggacccgttgggtaccgaaacggtaccttaccgttccaacgttcctaaacctaccttacggtcggacggccgggactcgggacaacggggcactagtacgnnnnnnnnnnnnnnnnnnnnnnn

SEQ ID NO: 61783 - DNA, 528 bp, Homo sapiens
  misc_feature: GYAE6OF01CAQWI.37.62.F07.1.454.CMB.1.raw
  modified_base (206)..(206): a, c, t, g, unknown or other
  misc_feature (206)..(206): n is a, c, g, or t
  modified_base (502)..(528): a, c, t, g, unknown or other
  misc_feature (502)..(528): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaatacggtctatctaggaaatgaacagcctgagagccgaggacacggccctntattactgtgcgagagatcaagacggagtatagcagcagctcgtagactacgtcggggacccgaccggaaccctggtcctacccggtcctcctaccacgccctaccccaacccgaacgggccccaacgttccggttccccttccccctcgggtcccacccctccctaccaacgacgctacctcggtcggggccacgacgcgcccgtggctcgcgtacggacaacggtactaccgttaccactacttacaacgtacgtcggaacggtcgggcgtcggacgaaggacacgagtaagcnnnnnnnnnnnnnnnnnnnnnnnnnnn

SEQ ID NO: 61784 - DNA, 562 bp, Homo sapiens
  misc_feature: GYAE6OF01AI8AH.37.62.F07.1.454.CMB.1.raw
  modified_base (99)..(99): a, c, t, g, unknown or other
  misc_feature (99)..(99): n is a, c, g, or t
  modified_base (142)..(142): a, c, t, g, unknown or other
  misc_feature (142)..(142): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (516)..(518): a, c, t, g, unknown or other
  misc_feature (516)..(518): n is a, c, g, or t
  modified_base (520)..(520): a, c, t, g, unknown or other
  misc_feature (520)..(520): n is a, c, g, or t
  modified_base (524)..(525): a, c, t, g, unknown or other
  misc_feature (524)..(525): n is a, c, g, or t
  modified_base (529)..(530): a, c, t, g, unknown or other
  misc_feature (529)..(530): n is a, c, g, or t
  modified_base (532)..(532): a, c, t, g, unknown or other
  misc_feature (532)..(532): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (550)..(551): a, c, t, g, unknown or other
  misc_feature (550)..(551): n is a, c, g, or t
  modified_base (554)..(556): a, c, t, g, unknown or other
  misc_feature (554)..(556): n is a, c, g, or t
  modified_base (558)..(558): a, c, t, g, unknown or other
  misc_feature (558)..(558): n is a, c, g, or t
tcagtagtgtagatcacgaccggtgctcgatttagtagtcgcataaaagggaaagggactggagtgggtctcaggtattggtggcagtggtgagaccanatactacgcagactccgtgaagggccggttcaccatctcaganacaattccaagaacaccctgtactctgcaaatgaacaacctgagacgccgaggacacggccctattattactgtaacgaaaatcggcctaacggatatacgacttactattgggactggttactttcgatctcgtcgggccgtggtcncctggtcacgtcgtctccgcncgcctccgaacgacggcccagtccggtcctttcccccgnggccctaccgtgtccctacgacggtccgacnccgtcgagacgcgacnccggccgtccgtcgggtctacggccgtttgacgaacgtaccttaccgttacacgtcctaacacgtacgtcgacggtccggacgtcgggaacgacggtccacgtaacgngacncgangcnnncngtannctcnncncgnngngnctncncncgnngcnnncngtgc

SEQ ID NO: 61785 - DNA, 598 bp, Homo sapiens
  misc_feature: GYAE6OF01BL8XD.37.62.F07.1.454.CMB.1.raw
  modified_base (368)..(368): a, c, t, g, unknown or other
  misc_feature (368)..(368): n is a, c, g, or t
  modified_base (495)..(495): a, c, t, g, unknown or other
  misc_feature (495)..(495): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(560): a, c, t, g, unknown or other
  misc_feature (559)..(560): n is a, c, g, or t
  modified_base (564)..(565): a, c, t, g, unknown or other
  misc_feature (564)..(565): n is a, c, g, or t
  modified_base (567)..(567): a, c, t, g, unknown or other
  misc_feature (567)..(567): n is a, c, g, or t
  modified_base (572)..(574): a, c, t, g, unknown or other
  misc_feature (572)..(574): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (586)..(587): a, c, t, g, unknown or other
  misc_feature (586)..(587): n is a, c, g, or t
  modified_base (589)..(589): a, c, t, g, unknown or other
  misc_feature (589)..(589): n is a, c, g, or t
  modified_base (591)..(593): a, c, t, g, unknown or other
  misc_feature (591)..(593): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
tcagtagtgtagatcacgaccggtgctcgatttagtagtcgcataaaagggaagggactgggagtgggtctcaggtattggtggcagtggtgagaccacatactacgcagactccgtgaagggccggttcaccatctccagagacaacttccaagaacaccctgtctctgacaaatacgaacaacctgagacgcgaggaccacgccctatattacgtagtaacgaaaatcggacctaacggatatacgaacttaacttagttgggactggttacttcgacttcgtcggtacggggccgtggccgtacccgtacggtcacgtgtccttacctcacgcctaccaccgacggcccagtccgtcctccccgngcccgcctcgcctcgacggcaccgtacccgtacgacgacgtaccacgacggccggccggtcggcgtccgtccggtacgtaacgaaccggtaccttaccgtacctaacttacctaaccgacgttacgngggtaccgggtcgggtccggttacgggaccgtaacggccgtaacgacgtagacncgtagngngnngcgnncncgacnnngncangnanncnngnannncngnn

SEQ ID NO: 61786 - DNA, 584 bp, Homo sapiens
  misc_feature: GYAE6OF01COPYF.37.62.F07.1.454.CMB.1.raw
  modified_base (553)..(555): a, c, t, g, unknown or other
  misc_feature (553)..(555): n is a, c, g, or t
  modified_base (557)..(563): a, c, t, g, unknown or other
  misc_feature (557)..(563): n is a, c, g, or t
  modified_base (565)..(584): a, c, t, g, unknown or other
  misc_feature (565)..(584): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattaccaagaacaccctgtctctgcaaatgaacaacctgagagcgaggacacgcctatactactgtaacgaaatggcctaacggatatgactactagtgggactggtacttcgatcgtcgtggggccgtggccaccgtggtctacgtcgtcctacctcacgcccctacccgaaccgaacgggcccctacgttcccggttccccgttacccccgtcggccgtccctacgccctacgggacggactccctaccgaccgacgacaccgaccgacggtcccggcgtcgggcctcggccgttacgaacggaacgttaaccgtcctttaccgattaaccgtacctaaccgttaccgtagggaccgggtcccggtacggtacggaaccggacgaccggtactagactacgctgannncnnnnnnngnnnnnnnnnnnnnnnnnnnn

SEQ ID NO: 61787 - DNA, 580 bp, Homo sapiens
  misc_feature: GYAE6OF01B1PP1.37.62.F07.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (393)..(393): a, c, t, g, unknown or other
  misc_feature (393)..(393): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (553)..(555): a, c, t, g, unknown or other
  misc_feature (553)..(555): n is a, c, g, or t
  modified_base (558)..(558): a, c, t, g, unknown or other
  misc_feature (558)..(558): n is a, c, g, or t
  modified_base (560)..(562): a, c, t, g, unknown or other
  misc_feature (560)..(562): n is a, c, g, or t
  modified_base (564)..(564): a, c, t, g, unknown or other
  misc_feature (564)..(564): n is a, c, g, or t
  modified_base (567)..(573): a, c, t, g, unknown or other
  misc_feature (567)..(573): n is a, c, g, or t
  modified_base (575)..(575): a, c, t, g, unknown or other
  misc_feature (575)..(575): n is a, c, g, or t
  modified_base (577)..(580): a, c, t, g, unknown or other
  misc_feature (577)..(580): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagacaccctgtctctgacaaatgaacaacctgagagcgagacacggcctatattacngtaacgaaaatggacctaacggatangactactatagggactgtacttcgatctacgtgggaccgtggaccacccgttgggtctaaccttgtcctacctcacgtcccctaccgaaccgaacgggccccagttcccggttaccttccccccgtagggcccgccccgttgccctaccgaagggaccncctaacccgtccggagacgaccacgtacggcccggtacccgtgggacctcggcgtacggtacgaaaggtaccttacgtctacgtcctaacacttacgagacggtacgggctacggaaccgtaggccgtacgtaagtacgngacgnganagcancgagngnnngancnnnanagnnnnnnncnannnn

SEQ ID NO: 61788 - DNA, 659 bp, Homo sapiens
  misc_feature: GYAE6OF01CJB3S.37.62.F07.1.454.CMB.1.raw
  modified_base (160)..(160): a, c, t, g, unknown or other
  misc_feature (160)..(160): n is a, c, g, or t
  modified_base (468)..(468): a, c, t, g, unknown or other
  misc_feature (468)..(468): n is a, c, g, or t
  modified_base (626)..(626): a, c, t, g, unknown or other
  misc_feature (626)..(626): n is a, c, g, or t
  modified_base (628)..(631): a, c, t, g, unknown or other
  misc_feature (628)..(631): n is a, c, g, or t
  modified_base (633)..(633): a, c, t, g, unknown or other
  misc_feature (633)..(633): n is a, c, g, or t
  modified_base (635)..(636): a, c, t, g, unknown or other
  misc_feature (635)..(636): n is a, c, g, or t
  modified_base (638)..(652): a, c, t, g, unknown or other
  misc_feature (638)..(652): n is a, c, g, or t
  modified_base (654)..(659): a, c, t, g, unknown or other
  misc_feature (654)..(659): n is a, c, g, or t
tcagtagtgtagatcacgaccggtgctcgatttagtagtcgcataaaaggggaaagggactggagtgggtctcaggtattggtgcagtggtgagaccacatactacgcagactcgtgaacgggtccgttcaccatcctccagagacaattccaagaaccnccctgtctctgacaaatgaaccaacctgaagacgaccgaggaccaccggtacctattaacttactgtaaacgaaaatcgggacctacggattatagacttacttagtggtacttcggttactcgtatccgtaggtcggggccgtcgccaccgttggaccctaccggtcttccttacccaccgtacgcccctaacccgaaccggaaacggtacccctcgttcccgggttaccccctttacccggccggtccgtccccctaggtacccgtacccggaaacggtacccgacccgttccgaaccggggtaanaccgtaccgacggttaccggcccggtccggtacggcctaacggtcccgtaaggaccgtaaacggttaccctttccacgtaacttccgtaaactacccgttaggtacgcgggtacggtaccgaacggtaccggaacgccggtaataccgggatcgctancnnnnancnnannnnnnnnnnnnnnncnnnnnn

SEQ ID NO: 61789 - DNA, 605 bp, Homo sapiens
  misc_feature: GYAE6OF01E4EX5.37.62.F07.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
  modified_base (575)..(575): a, c, t, g, unknown or other
  misc_feature (575)..(575): n is a, c, g, or t
  modified_base (584)..(584): a, c, t, g, unknown or other
  misc_feature (584)..(584): n is a, c, g, or t
  modified_base (592)..(592): a, c, t, g, unknown or other
  misc_feature (592)..(592): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagacgccgagacacggccctatacttactgtacgaaaatggacctaggatatgaccttactattcgggactgggttacttcgatctcgnggggccgtggccacccgtggctactgtcctctcncgcctccacacggcccatccggtccttccccgtggccctccctgcctccgaggagcccacctccggagcgaccacgacggcccgggaccgtcgggactcggtccctgggtaacaacgggtaaccttaccgttacccagtaccccttaacaaccgttacgaggtaccggaccgggtcgtacgggacgtaaccgggccgacgtaacgtaaggcncgngacctgactagntccagtngttaacgngacgcggtnaacgtcgacgtccgagtcncgtcgccgngttaaccngactcgcgtcgcg

SEQ ID NO: 61790 - DNA, 580 bp, Homo sapiens
  misc_feature: GYAE6OF01C7OHP.37.62.F07.1.454.CMB.1.raw
  modified_base (550)..(555): a, c, t, g, unknown or other
  misc_feature (550)..(555): n is a, c, g, or t
  modified_base (557)..(580): a, c, t, g, unknown or other
  misc_feature (557)..(580): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgacaaatgaacaacctgagagccgaggacacggccctatattactgaacgaaaatcggacctacggatatgacttactagttgggacttggtacttcgattcgtcgtcgggccgtcggcctacccgtggtcctactcgtcctcctcacgcccctcccacccgaacggccctacgtccggttccccgttcccccgtcggcccgtccccttcgccgtaccgacgggacacccgacccgtaccgagacgaccacgcggccggcccgtcggccgtcgccgtaggaccgtaacggtacctacccgttacctacgtaccctaacctaaccgttacgtacgggaacggccgggtcggtacggacggtaacgggaccgtacgacgtacgnnnnnnannnnnnnnnnnnnnnnnnnnnnnn

SEQ ID NO: 61791 - DNA, 563 bp, Homo sapiens
  misc_feature: GYAE6OF01AX74O.37.62.F07.1.454.CMB.1.raw
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (536)..(563): a, c, t, g, unknown or other
  misc_feature (536)..(563): n is a, c, g, or t
tcagtagtgtagatcacgaccggtgctcgatttagtagtcgcataaagggaaagggactgggagtgggtctcaggtattggtggcagtggtgagaccacatactacgcagactccgtgaagggccggttcaccatctccagagacaattccaagaacaccctgtctctcgcaaatgaacaacctgagagccgaggacaccggccctatacttactagtacgaaaatggcctaacggattatgactactattgggactggtacttcgattcctcgcggggccgtggccacccgtggtctacgtcgtcctcctcacgtccctaccacccgaacgggtccccagttcccggtcccttcccccgtggcccgtccccgtcgccctccgaacggaccgcctacccgtccgaagtacgccgacgcggccggccccgtgggcctcggccgtggtaaccgaacggtaccttacctcctacttcctacacgtacgtggacgggcgggtcgcggtaaccggacgggcctacgtaagtcgntancgtnnnnnnnnnnnnnnnnnnnnnnnnnnnn

SEQ ID NO: 61792 - DNA, 692 bp, Homo sapiens
  misc_feature: GYAE6OF01ACO1L.37.62.F07.1.454.CMB.1.raw
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (619)..(619): a, c, t, g, unknown or other
  misc_feature (619)..(619): n is a, c, g, or t
  modified_base (627)..(627): a, c, t, g, unknown or other
  misc_feature (627)..(627): n is a, c, g, or t
  modified_base (637)..(637): a, c, t, g, unknown or other
  misc_feature (637)..(637): n is a, c, g, or t
  modified_base (678)..(678): a, c, t, g, unknown or other
  misc_feature (678)..(678): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacacctgtctctgcaaatgaacaacctgagacgccgaggacacggcctatattactgtaacgaaaatggcctaacggatatagacctaactagttgggacctagggtacctttacgattcgtacggtcggggtccgtcggtaccacccgtgggtacctaaccgttggttcctccctacacggccccttacccaaccgaaacggggtcccaagtttcccggtcccttcccccgtggcccgtacccgttgccttacccggaaggacgtaccctaacccgtccggaagacggacctaacgacggtcccggaccgtcgggccttacgggcccgttacgggtaaacctaaacgggtacccttactttaacccaacgtttacccgaaaccgtactaaccggtacggaccgggttcggaccgtgggtaacccgaaagggtcccgtaacgaacttagacgacgntactancganacgagtanacgtagtacngactgagagtagactcgtagtactactagtactactactanagtctcgacgtacg

SEQ ID NO: 61793 - DNA, 538 bp, Homo sapiens
  misc_feature: GYAE6OF01DTMPY.37.62.F07.1.454.CMB.1.raw
  modified_base (511)..(538): a, c, t, g, unknown or other
  misc_feature (511)..(538): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatcggcctacggatatgactactagttgggactggtacttcgatctcgtgggccgtggccaccgtggtccactgtctcctcgacgccctccgaaccgacgggcccagtccggtccttcccccgtggccgcccctgccttccgaggacgcctacccgtccgagtacgcgaacgacggcccggtacccgtgggcctcggtcccgtggtaccgaaacggtaccttaccttaccacgttccctaaccgtacctacgtaggacggtccgggactcgggacaacgggcacgagtcgnnnnnnnnnnnnnnnnnnnnnnnnnnnn

SEQ ID NO: 61794 - DNA, 539 bp, Homo sapiens
  misc_feature: GYAE6OF01BQ93J.37.62.F07.1.454.CMB.1.raw
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(508): a, c, t, g, unknown or other
  misc_feature (506)..(508): n is a, c, g, or t
  modified_base (512)..(513): a, c, t, g, unknown or other
  misc_feature (512)..(513): n is a, c, g, or t
  modified_base (515)..(523): a, c, t, g, unknown or other
  misc_feature (515)..(523): n is a, c, g, or t
  modified_base (525)..(531): a, c, t, g, unknown or other
  misc_feature (525)..(531): n is a, c, g, or t
  modified_base (533)..(536): a, c, t, g, unknown or other
  misc_feature (533)..(536): n is a, c, g, or t
  modified_base (538)..(539): a, c, t, g, unknown or other
  misc_feature (538)..(539): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtgcgagagatcaagacggatatagcagcagctngactacgcgggaccacggaaccctgtccacccgtcncctcacgccctaccgaaccgaaccggccacgttccggtacccttcccccgnggaccctcccgtccctaccgaacgtacgacctaccgtcggtcggggaccacgcggccggtcccgcggccgtcgccgtacggactaacggtaccttacctccattcctaactacctacgaggtacggcgggtcgtacggacgacggaccgagtacgaggcagngctacgncnannnacgnncnnnnnnnnncnnnnnnncnnnngnn

SEQ ID NO: 61795 - DNA, 635 bp, Homo sapiens
  misc_feature: GYAE6OF01EIXNU.37.62.F07.1.454.CMB.1.raw
  modified_base (309)..(309): a, c, t, g, unknown or other
  misc_feature (309)..(309): n is a, c, g, or t
  modified_base (569)..(569): a, c, t, g, unknown or other
  misc_feature (569)..(569): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (599)..(599): a, c, t, g, unknown or other
  misc_feature (599)..(599): n is a, c, g, or t
  modified_base (608)..(608): a, c, t, g, unknown or other
  misc_feature (608)..(608): n is a, c, g, or t
  modified_base (614)..(615): a, c, t, g, unknown or other
  misc_feature (614)..(615): n is a, c, g, or t
  modified_base (617)..(618): a, c, t, g, unknown or other
  misc_feature (617)..(618): n is a, c, g, or t
  modified_base (625)..(625): a, c, t, g, unknown or other
  misc_feature (625)..(625): n is a, c, g, or t
  modified_base (627)..(628): a, c, t, g, unknown or other
  misc_feature (627)..(628): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgacaaatgaacaactgagagccgaggacaccggccctatattactagtaacgaaaatcggacctacggattatacgtacttatagttgggactggttacttcgatctcgtggggccgttgcctaccgtgtcactgtctccncacgcctaccgaccgacgggccctagttcccggtccctttacccccggtggcccgtcccgttcgtcctaccgaacgggtaccgcctaccccgtacggaacaccggacaaccgacgggcccggtccccggtagggtccgtccgtccgttcgggtaacgaaacgggttaccttaaccgttacccgaattaccgtaccgtaacgttacgagggtaccgggtccgggttacgacgggtaccgaacgggtccgtacaagggtacncgtanacgntgngancgngcncagcngagngcgacgacncgcagnngnngacgacncnnctntgtn

SEQ ID NO: 61796 - DNA, 721 bp, Homo sapiens
  misc_feature: GYAE6OF01B2ORV.37.62.F07.1.454.CMB.1.raw
  modified_base (128)..(128): a, c, t, g, unknown or other
  misc_feature (128)..(128): n is a, c, g, or t
  modified_base (135)..(135): a, c, t, g, unknown or other
  misc_feature (135)..(135): n is a, c, g, or t
  modified_base (185)..(185): a, c, t, g, unknown or other
  misc_feature (185)..(185): n is a, c, g, or t
  modified_base (457)..(457): a, c, t, g, unknown or other
  misc_feature (457)..(457): n is a, c, g, or t
  modified_base (658)..(658): a, c, t, g, unknown or other
  misc_feature (658)..(658): n is a, c, g, or t
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
  modified_base (676)..(676): a, c, t, g, unknown or other
  misc_feature (676)..(676): n is a, c, g, or t
  modified_base (681)..(683): a, c, t, g, unknown or other
  misc_feature (681)..(683): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (700)..(700): a, c, t, g, unknown or other
  misc_feature (700)..(700): n is a, c, g, or t
  modified_base (703)..(703): a, c, t, g, unknown or other
  misc_feature (703)..(703): n is a, c, g, or t
  modified_base (705)..(706): a, c, t, g, unknown or other
  misc_feature (705)..(706): n is a, c, g, or t
  modified_base (711)..(711): a, c, t, g, unknown or other
  misc_feature (711)..(711): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccgttnaccatcnccagagacaataccaagaacaccctgtctctgcaaatagaacaacctagngagccgaggacacgcctattatacgtagtaacgaaatcgaccgtacgtatatagactaactagttacgggactagtctttacgactacttcggtcggggtccgtcggaccgaccctacggtacctctagttccgtcccctacgtacccgaccctacccgtaaacccggaaccgggaccccaacgtttccccggttaccccggtttccccccgtacgggccgtcccccgttacgtcccggtacccgtacggacgaccccgtcctacccggganacgccaaacccggacggccccgggtacccccggttggcccggtacgtacccgggttccggttaacggtaaacggttaaaccccgtttaccttaccccgttacgttcccgttaaacccgttaaccgttacccggttacgggaaacccgggtcccggggtaacggtcccgggtaaccggtaccgggaccgtcggtaacgtaanccgtnacgancgatacgngtacnnnganantgacgagcacgnagncnngcgancgncngtgcg

SEQ ID NO: 61797 - DNA, 634 bp, Homo sapiens
  misc_feature: GYAE6OF01B61BZ.37.62.F07.1.454.CMB.1.raw
  modified_base (589)..(589): a, c, t, g, unknown or other
  misc_feature (589)..(589): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (598)..(599): a, c, t, g, unknown or other
  misc_feature (598)..(599): n is a, c, g, or t
  modified_base (601)..(601): a, c, t, g, unknown or other
  misc_feature (601)..(601): n is a, c, g, or t
  modified_base (607)..(608): a, c, t, g, unknown or other
  misc_feature (607)..(608): n is a, c, g, or t
  modified_base (612)..(613): a, c, t, g, unknown or other
  misc_feature (612)..(613): n is a, c, g, or t
  modified_base (616)..(617): a, c, t, g, unknown or other
  misc_feature (616)..(617): n is a, c, g, or t
  modified_base (619)..(620): a, c, t, g, unknown or other
  misc_feature (619)..(620): n is a, c, g, or t
  modified_base (622)..(623): a, c, t, g, unknown or other
  misc_feature (622)..(623): n is a, c, g, or t
  modified_base (627)..(629): a, c, t, g, unknown or other
  misc_feature (627)..(629): n is a, c, g, or t
  modified_base (631)..(632): a, c, t, g, unknown or other
  misc_feature (631)..(632): n is a, c, g, or t
  modified_base (634)..(634): a, c, t, g, unknown or other
  misc_feature (634)..(634): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccgttcaccatctcagagacaattccaagaacaccctgtctctgcaaatgaacaacctgagacgccgaggacacggcctatattactgtaacgaaaatcggcctacggatatgactactagttgggacttggtactcgattcgtcgtcgggcgtggccaccgtgtctacgtgttcctctcgacgtcctaccgaaccgaacggccctagtccggttcccttccccggaggtcccgtcccgttacggccctccggaacggaccgacccgtaccgtccggaacgacgacccgtaccggaacggcccgggtcccgtcgggtcctacggtcccgttaacgggtaccgtaaacggtcccgtttaaccgttacctaccttaccgtaaaaccgtcccggtagggaacccgggtccgggtacgtaccgggaaccggttaacgggcccgtaagtaagttacgcgcactcgcgttaccncnncnctcnncncacgcnnctcnngcnncnncnncgtnnncnngn

SEQ ID NO: 61798 - DNA, 574 bp, Homo sapiens
  misc_feature: GYAE6OF01ECSTD.37.62.F07.1.454.CMB.1.raw
  modified_base (213)..(213): a, c, t, g, unknown or other
  misc_feature (213)..(213): n is a, c, g, or t
  modified_base (361)..(361): a, c, t, g, unknown or other
  misc_feature (361)..(361): n is a, c, g, or t
  modified_base (409)..(409): a, c, t, g, unknown or other
  misc_feature (409)..(409): n is a, c, g, or t
  modified_base (533)..(533): a, c, t, g, unknown or other
  misc_feature (533)..(533): n is a, c, g, or t
  modified_base (542)..(542): a, c, t, g, unknown or other
  misc_feature (542)..(542): n is a, c, g, or t
  modified_base (546)..(547): a, c, t, g, unknown or other
  misc_feature (546)..(547): n is a, c, g, or t
  modified_base (549)..(574): a, c, t, g, unknown or other
  misc_feature (549)..(574): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaaccaccctgtctctgacaaatgaacaactgagacgccgaggacacggccctatattacngtaaccgaaaatcggcctaggatagtgacttactagttgggacctggttacttcgatcctcgtcggggccgtggcctacccgtggtccacttgtcctcctgacctcccctccaaccgacgggccctagtcccggtccctttcccccgnggacccgtccctaggccctaccggaggtccaccctacccgtaccgganacgtccacggtcggcccggtcccgtggggcctcgtcccgtagggtaccgaaacgttcctaccttccgtactaccgtactaccttagtaccggtacgggccggacgtggaccgtacgggccgtanacgtagctncgtnnannnnnnnnnnnnnnnnnnnnnnnnnn

SEQ ID NO: 61799 - DNA, 499 bp, Homo sapiens
  misc_feature: GYAE6OF01BHVZU.37.62.F07.1.454.CMB.1.raw
  modified_base (140)..(140): a, c, t, g, unknown or other
  misc_feature (140)..(140): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (438)..(438): a, c, t, g, unknown or other
  misc_feature (438)..(438): n is a, c, g, or t
  modified_base (472)..(472): a, c, t, g, unknown or other
  misc_feature (472)..(472): n is a, c, g, or t
  modified_base (475)..(476): a, c, t, g, unknown or other
  misc_feature (475)..(476): n is a, c, g, or t
  modified_base (478)..(499): a, c, t, g, unknown or other
  misc_feature (478)..(499): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcacatctccagngacaattccaagaacaccctgtctctgacaaatgaacaacctgagagccgaggacacggccctatattactgtaacgaaaatggcctacggatatgactactattgggactggtacttcgatcgtcgtggggccgtggccacccgtggtcactgtctctcacgccctcaaccaacgggtcccagtccggtcccttccccgtggcccncccgtgcctacgacggacncgccgtccgagacgacacgacgccgccgtgggcncgccgtggactaaggaccttacgttcaacgtcctaacnctacgtagacggtcggacgtggacgaagggccanagnncnnnnnnnnnnnnnnnnnnnnnn

SEQ ID NO: 61800 - DNA, 575 bp, Homo sapiens
  misc_feature: GYAE6OF01AYK2Q.37.62.F07.1.454.CMB.1.raw
  modified_base (187)..(187): a, c, t, g, unknown or other
  misc_feature (187)..(187): n is a, c, g, or t
  modified_base (362)..(362): a, c, t, g, unknown or other
  misc_feature (362)..(362): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (520)..(520): a, c, t, g, unknown or other
  misc_feature (520)..(520): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(549): a, c, t, g, unknown or other
  misc_feature (545)..(549): n is a, c, g, or t
  modified_base (551)..(575): a, c, t, g, unknown or other
  misc_feature (551)..(575): n is a, c, g, or t
tcagtagtgtagatcacgaccggtgctcgatttagtagtcgcataaagggaaagggactggagtgggtctcaggtattgggtggcagtggtgagaccacatactacgcagactccgtgaagggccggttcaccatctccagagacaattccaagaacaccctgtctctgacaaatgaaccaactgangccgaggaccacggtcctatattactgtaacgaaaatggacctaacggatatgacttactagtagggactggtacttcgatctcgtggggccgtggccaccctggtctacgtgtccctcctcgacgtccctacccaacgaaccgggccctacgtccggttcccctttcccccggnggcccgaccctttgcccgttaccgacggggaccnccgtaaccccgtccggaacncgtacccgaacgccggacccggtcccggtaacgggcctcggcgttacggacgaaacgtcccttacgtcctacttacctaccactacgtggacggtccggtacgngacgtacggctaagctacggngnannnnngnnnnnnnnnnnnnnnnnnnnnnnnn

SEQ ID NO: 61801 - DNA, 664 bp, Homo sapiens
  misc_feature: GYAE6OF01AQENV.37.62.F07.1.454.CMB.1.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (566)..(566): a, c, t, g, unknown or other
  misc_feature (566)..(566): n is a, c, g, or t
  modified_base (582)..(582): a, c, t, g, unknown or other
  misc_feature (582)..(582): n is a, c, g, or t
  modified_base (622)..(622): a, c, t, g, unknown or other
  misc_feature (622)..(622): n is a, c, g, or t
  modified_base (629)..(629): a, c, t, g, unknown or other
  misc_feature (629)..(629): n is a, c, g, or t
tcagtagtgtagatcacgaccggtgctcgatttagtagtcgcataaagggaaagggacgtggagtgggtctcaggtattggtggcagtggtgagaccacatactacgcagactccgtgaagggccggttcaccatctccagagacaattccaagaacaccctgtctctgacaaatgaacaacctgagacgccgaggacacggccctatattactgtaacgaaaatggacctagatatgactactagtggactggtacttgatcgtcgtcgggccgtggacacccgttggtcctactgtcctccncacgacctccaacgaacggccactcggtccttcccccgngcccgtcctcgcctaccgaggaccgaccgtaaccctcccggaaggacgccgaaaccgcggccggtccccgtcgggtacctcggtacccgttagggttaaccgaaacgggtaacttacccgttacctaactacccttaacctaacgttaaccgtagggaaccgggtccgggtaccggtacggaacgaacgggtaccggtaacgtaaccgtaggactactacganagactaacgctaacgnacacacgttacaacgacctagtaccgaacgtgtaacccgnggtaacncgtacgtcgttacgacgttacagtacctgacgacg

SEQ ID NO: 61802 - DNA, 709 bp, Homo sapiens
  misc_feature: GYAE6OF01CRRQJ.37.62.F07.1.454.CMB.1.raw
  modified_base (142)..(142): a, c, t, g, unknown or other
  misc_feature (142)..(142): n is a, c, g, or t
  modified_base (662)..(662): a, c, t, g, unknown or other
  misc_feature (662)..(662): n is a, c, g, or t
  modified_base (677)..(677): a, c, t, g, unknown or other
  misc_feature (677)..(677): n is a, c, g, or t
  modified_base (680)..(680): a, c, t, g, unknown or other
  misc_feature (680)..(680): n is a, c, g, or t
  modified_base (682)..(709): a, c, t, g, unknown or other
  misc_feature (682)..(709): n is a, c, g, or t
tcagtagtgtagatcacgaccggtgctcgatttagtagtcgcataaaaggggaaagggactggagtgggtctcaggtattgggtggcagtgggtgagaccacatactacgcagactccggtagaacgggccggttcacatcnccagagacaattccaaagaaccaccctgtctctacgacaaatgaaccaacctggagacgaccggaaggaccaccggtaccctaattaacttactaggtaaaacgaaaagtcggtaaccgtaaggattaagtacgtaaacttaacgttaggttacggggtacttacgggttacttacgattccggttcgggttcgggggccgttcggcccgtacccggttaggtcctaccgttcgttccctaaccgtacgacccgtaccccttaccccgaaaaccggtaccgggaccccttaacggtttccccgggttccccccttcccccggtacggggtcccctaccccgttacgaccccgtaccgggaacggaccctaccccgaccgtaccggaacgtaccaccggaaccggccggttcccggaacccggttggccgttaccggtcggtacggttaaaacgaccgtttacctacctttacgaaccttcctaacctacgttacggagggtaccccggtgcgtaacgggntaacgggctaacgancgncnnnnnnnnnnnnnnnnnnnnnnnnnnnn

SEQ ID NO: 61803 - DNA, 670 bp, Homo sapiens
  misc_feature: GYAE6OF01DDGWZ.37.62.F07.1.454.CMB.1.raw
  modified_base (161)..(161): a, c, t, g, unknown or other
  misc_feature (161)..(161): n is a, c, g, or t
  modified_base (617)..(617): a, c, t, g, unknown or other
  misc_feature (617)..(617): n is a, c, g, or t
  modified_base (623)..(623): a, c, t, g, unknown or other
  misc_feature (623)..(623): n is a, c, g, or t
  modified_base (627)..(627): a, c, t, g, unknown or other
  misc_feature (627)..(627): n is a, c, g, or t
  modified_base (629)..(630): a, c, t, g, unknown or other
  misc_feature (629)..(630): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (643)..(645): a, c, t, g, unknown or other
  misc_feature (643)..(645): n is a, c, g, or t
  modified_base (647)..(648): a, c, t, g, unknown or other
  misc_feature (647)..(648): n is a, c, g, or t
  modified_base (652)..(652): a, c, t, g, unknown or other
  misc_feature (652)..(652): n is a, c, g, or t
  modified_base (656)..(659): a, c, t, g, unknown or other
  misc_feature (656)..(659): n is a, c, g, or t
  modified_base (661)..(662): a, c, t, g, unknown or other
  misc_feature (661)..(662): n is a, c, g, or t
  modified_base (664)..(670): a, c, t, g, unknown or other
  misc_feature (664)..(670): n is a, c, g, or t
tcagtagtgtagatcacgaccggtgctcgatttagtagtcgcataaaggggaaagggactggagtgggtctcaggtattggtggcagtggtgagaccacatactacgcagactccgtgaagggtccgttcacatctccagagacattccaagaacaccctntctctgacaaatgaacactgagacgcgagacacggcctatactactgaacgaaatcggacctacgatatgaactagtagtggacttggtactgtctcgtggcggggtcgtcggcctaccgtggtacctacgtcgttcctcctcaccggccctaccgaaccggacggtcctacgttccggtttccctccccggtcggtcccgtcccgtacgtccgtaacgacggtccgtaccctaaccggttccggacggacgaccgaaccgtacccggggtcggggtccccgggttcgggaccgtttccggggtacccggtttacggggtaaaaccggtaacccggtttaaaccctttaacccgtttaccgtaaacctttacccggttaaacctaccggtttaaccgtaacgggggtacccgtcggggaccggttaacgggaaccggtaccggacggtaactacgnggtacngtcngnngactcgtntntgnnncnntcanacgnnnncnncnnnnnnn

SEQ ID NO: 61804 - DNA, 438 bp, Homo sapiens
  misc_feature: GYAE6OF02G3X9H.37.62.F07.1.454.CMB.1.raw
  modified_base (431)..(438): a, c, t, g, unknown or other
  misc_feature (431)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnnnn

SEQ ID NO: 61805 - DNA, 439 bp, Homo sapiens
  misc_feature: GYAE6OF02I64LG.37.62.F07.1.454.CMB.1.raw
  modified_base (431)..(439): a, c, t, g, unknown or other
  misc_feature (431)..(439): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctgggcaaggcgcatagnnnnnnnnn

SEQ ID NO: 61806 - DNA, 450 bp, Homo sapiens
  misc_feature: GYAE6OF02H1KCI.37.62.F07.1.454.CMB.1.raw
  modified_base (428)..(428): a, c, t, g, unknown or other
  misc_feature (428)..(428): n is a, c, g, or t
  modified_base (437)..(450): a, c, t, g, unknown or other
  misc_feature (437)..(450): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatgggcctacggatatgactactattggactggtacttcgatctctgggccgtggcaccctggtcactgtctcctcagcctccaccaagggcccatcggcttcccctgcgccctgctccaggagcacctcgagacgcacagcggcctgggctcgcctggtcaaggactaccttccatcctaacacttactgagcgggctcggcaaggcncagtagcannnnnnnnnnnnnn

SEQ ID NO: 61807 - DNA, 465 bp, Homo sapiens
  misc_feature: GYAE6OF02I61Y8.37.62.F07.1.454.CMB.1.raw
  modified_base (416)..(416): a, c, t, g, unknown or other
  misc_feature (416)..(416): n is a, c, g, or t
  modified_base (437)..(452): a, c, t, g, unknown or other
  misc_feature (437)..(452): n is a, c, g, or t
  modified_base (454)..(465): a, c, t, g, unknown or other
  misc_feature (454)..(465): n is a, c, g, or t
tcagtagtgtagatcacgaccggtgctcgatttagtagtcgcataaagggaagggactggagtgggtctcaggtattggtggcagtggtgtagaccacatactacgcagactccgtgaagggccggttcaccatctccagagacaattccaagaactaccctgtctctgtcaaatgaacaacctgagagccgaggacacgggccctatattacgtgtgtgaagggacctctagccccttatagcagcggctggtcctggtactttgacgactggggccagggacccctggtcaccgtctcctcagcctccaccaagggcccatcggtcttccccctggcgccctgctccaggagcacctcgagagcacagcggcctgggctgcctggtcaaggctacttcgatctacactactgancgggctggcaaggcgcatagnnnnnnnnnnnnnnnngnnnnnnnnnnnn

SEQ ID NO: 61808 - DNA, 438 bp, Homo sapiens
  misc_feature: GYAE6OF02GMKPL.37.62.F07.1.454.CMB.1.raw
  modified_base (432)..(438): a, c, t, g, unknown or other
  misc_feature (432)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnnn

SEQ ID NO: 61809 - DNA, 436 bp, Homo sapiens
  misc_feature: GYAE6OF02H48B5.37.62.F07.1.454.CMB.1.raw
  modified_base (433)..(436): a, c, t, g, unknown or other
  misc_feature (433)..(436): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacccctggtcactgtctcctcagcctccacccaagggcccatcggtcttcccctggcgccctgctccaggagcacctccgagagcacagcggccctgggctgcctggtcaaggactacttccatctacactactgagcgggctggcaaggcgcatagnnnn

SEQ ID NO: 61810 - DNA, 437 bp, Homo sapiens
  misc_feature: GYAE6OF02H54Q6.37.62.F07.1.454.CMB.1.raw
  modified_base (431)..(437): a, c, t, g, unknown or other
  misc_feature (431)..(437): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctcaccaagggcccatcggtcttcccctgcgccctgctccaggagcacctccgagagcacagcggccctgggctgcctggtcaaggactacgttccatctacactactgagcgggctgggcaaggcgcatagnnnnnnn

SEQ ID NO: 61811 - DNA, 435 bp, Homo sapiens
  misc_feature: GYAE6OF02GKKVS.37.62.F07.1.454.CMB.1.raw
  modified_base (432)..(435): a, c, t, g, unknown or other
  misc_feature (432)..(435): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaggactacttccatctacactactgagcgggctggcaaggcgcatagnnnn

SEQ ID NO: 61812 - DNA, 465 bp, Homo sapiens
  misc_feature: GYAE6OF02GWQG1.37.62.F07.1.454.CMB.1.raw
  modified_base (450)..(465): a, c, t, g, unknown or other
  misc_feature (450)..(465): n is a, c, g, or t
tcagtagtgtagatcacgaccggtgctcgatttagtagtcgcataaagggaaagggactgggagtgggtctccacggtatttcggtgggcagtggtgagaccacatactacgcagactccgtgaagggccggttcaccatctccagagacaattccaagaactaccctgtctctgtcaaatgaacaacctgagagccgaggacacggccctatattacgtgtacgaaaatggcctacggagtactgactactattgggactggtacttcgatctctgggccgtggcaccctggttcactgtctcctcagccgtccaccaaggggcccatcggtacttccccctggacgcccctgctccaggtagcgacctccgagagcaacagcggcccctgggctgcctggtcaaggactacttccatctacactactgagcggctgcaagcgcatagnnnnnnnnnnnnnnnn

SEQ ID NO: 61813 - DNA, 433 bp, Homo sapiens
  misc_feature: GYAE6OF02GKGDQ.37.62.F07.1.454.CMB.1.raw
  modified_base (429)..(433): a, c, t, g, unknown or other
  misc_feature (429)..(433): n is a, c, g, or t
tcagtagtgtagatcacgaccggtgctcgatttagtagtcgcataagggaagggactggagtgggtctcaggtattggtggcagtggtgagaccacatactacgcagactccgtgaaggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgccctggtcaaggctacttccatctacactactgagcgggctggcaaggcgcatagnnnnn

SEQ ID NO: 61814 - DNA, 439 bp, Homo sapiens
  misc_feature: GYAE6OF02H6MTB.37.62.F07.1.454.CMB.1.raw
  modified_base (426)..(426): a, c, t, g, unknown or other
  misc_feature (426)..(426): n is a, c, g, or t
  modified_base (432)..(439): a, c, t, g, unknown or other
  misc_feature (432)..(439): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactactttcatctacactactgagcgggctggcaaggcncatagnnnnnnnn

SEQ ID NO: 61815 - DNA, 426 bp, Homo sapiens
  misc_feature: GYAE6OF02FUMYO.37.62.F07.1.454.CMB.1.raw
  modified_base (420)..(426): a, c, t, g, unknown or other
  misc_feature (420)..(426): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtgcgagagatcagacggagtatagcagcagctctgactactggggccacggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnnnnnn

SEQ ID NO: 61816 - DNA, 436 bp, Homo sapiens
  misc_feature: GYAE6OF02GR225.37.62.F07.1.454.CMB.1.raw
  modified_base (428)..(436): a, c, t, g, unknown or other
  misc_feature (428)..(436): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaggctacttccatctactactgagcgggctggcaaggcgcatagnnnnnnnnn

SEQ ID NO: 61817 - DNA, 437 bp, Homo sapiens
  misc_feature: GYAE6OF02JU4UP.37.62.F07.1.454.CMB.1.raw
  modified_base (429)..(437): a, c, t, g, unknown or other
  misc_feature (429)..(437): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactactccatctacactactgagcggctggcaaggcgcatagnnnnnnnnn

SEQ ID NO: 61818 - DNA, 611 bp, Homo sapiens
  misc_feature: GYAE6OF02G9ZVF.37.62.F07.1.454.CMB.1.raw
  modified_base (540)..(540): a, c, t, g, unknown or other
  misc_feature (540)..(540): n is a, c, g, or t
  modified_base (573)..(573): a, c, t, g, unknown or other
  misc_feature (573)..(573): n is a, c, g, or t
tcagtagtgtagatcacgaccggtgctcgatttagtagtcgcataaagggaaaggggacgtggagtggggtcgtcaggtattggtggcgaagtggtgagaccacgatacgtaccgcacgactccgttccgaacgggccggtttctaccatcctccagagacaattccaagaacacctgtctctgcaaatgaacaacctgagagccgaggaccacggaccctaagtacttacgtgtacgaaaactggcctacggagtatgactactagttggaactggtacttcgatcgtctgggccgtggcacctggtcacgtcgtctcctcgacgcctccacgaagggccacgttcggtccttccccgaggccgtcccgtcgtccctccgaggacgcctaccgtccgacgcgccacgacgccggaccgtcggcgtcgccgttcggtacgaaacgtaccttacgtaccgcgttacccgtagtaccgtacgtgacggcgggtctaggaaccgtacggcgttacgtaagtcgactgctagactgtcagtcgngtacgtcgcggacgacgagtcgtcgtcgtcgcncgcgacgcgcgccgccggtccgtcgtcgtccgtcctcc

SEQ ID NO: 61819 - DNA, 438 bp, Homo sapiens; identical to SEQ ID NO: 61808
  misc_feature: GYAE6OF02HBWIS.37.62.F07.1.454.CMB.1.raw
  modified_base (432)..(438): a, c, t, g, unknown or other
  misc_feature (432)..(438): n is a, c, g, or t

SEQ ID NO: 61820 - DNA, 530 bp, Homo sapiens
  misc_feature: GYAE6OF02GFNI4.37.62.F07.1.454.CMB.1.raw
  modified_base (483)..(485): a, c, t, g, unknown or other
  misc_feature (483)..(485): n is a, c, g, or t
  modified_base (487)..(488): a, c, t, g, unknown or other
  misc_feature (487)..(488): n is a, c, g, or t
  modified_base (490)..(491): a, c, t, g, unknown or other
  misc_feature (490)..(491): n is a, c, g, or t
  modified_base (493)..(494): a, c, t, g, unknown or other
  misc_feature (493)..(494): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(512): a, c, t, g, unknown or other
  misc_feature (510)..(512): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (519)..(519): a, c, t, g, unknown or other
  misc_feature (519)..(519): n is a, c, g, or t
  modified_base (521)..(523): a, c, t, g, unknown or other
  misc_feature (521)..(523): n is a, c, g, or t
  modified_base (525)..(528): a, c, t, g, unknown or other
  misc_feature (525)..(528): n is a, c, g, or t
  modified_base (530)..(530): a, c, t, g, unknown or other
  misc_feature (530)..(530): n is a, c, g, or t
tcagtagtgtagatcacgaccggtgctcgattttagtagtcgcataaagggaaaggggactggagtaggggtcttcgagggttattggtgggccaaggtggttgagtaccacattactacgcaggactccgttgaagggccggttccaccgaggtctccacgagacaattcccaagaaccacctgtctctgcaaatgacaacctgagagcgagacaggcctatatactgtacgaaaatggcctacggattatgactactattagggactagggtacttcgtatcttcgtggggccgtggcaaacccctggtcactgtctacctcagcctccaccaagggccatcggtcttcccccgtgccgccctcgctcccaggtacgcaccgtccgagacggcacgagcggccctgggcctgccctggtcaacggactactttacccatcctacgacttacgtagagtcgggctggactaaggcgcatagnnntnnanncnnacgtgngngcgngngnnngnanngngnnncnnnntn

SEQ ID NO: 61821 - DNA, 415 bp, Homo sapiens
  misc_feature: GYAE6OF02HB0SC.37.62.F07.1.454.CMB.1.raw
  modified_base (404)..(404): a, c, t, g, unknown or other
  misc_feature (404)..(404): n is a, c, g, or t
  modified_base (410)..(415): a, c, t, g, unknown or other
  misc_feature (410)..(415): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaacgggcccatcggtcttccccctggtacccctcctccaagacgcacctctggggcacagcggccctgggctgcctggtcaaggactacttccatctacactactgagcgggctggcaaggcncatagnnnnnn

SEQ ID NO: 61822 - DNA, 441 bp, Homo sapiens
  misc_feature: GYAE6OF02G6SJG.37.62.F07.1.454.CMB.1.raw
  modified_base (431)..(441): a, c, t, g, unknown or other
  misc_feature (431)..(441): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnnnnnnn

SEQ ID NO: 61823 - DNA, 431 bp, Homo sapiens
  misc_feature: GYAE6OF02FF0BP.37.62.F07.1.454.CMB.1.raw
  modified_base (429)..(431): a, c, t, g, unknown or other
  misc_feature (429)..(431): n is a, c, g, or t
tcagtagtgtagatcacgaccggtgctcgatttagtagtcgcataaagggaaagggactggagtgggtctcaggtattggtggcagtggtgagaccacatactacgcagactccgtgaaggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtcttcccctggcgccctgctccaggagcacctccgagagcacagcggccctgggctgcctggtcaaggatacttccatctacactactgagcgggctggcaaggcgcatagnnn

SEQ ID NO: 61824 - DNA, 412 bp, Homo sapiens
  misc_feature: GYAE6OF02F6H4S.37.62.F07.1.454.CMB.1.raw
  modified_base (408)..(412): a, c, t, g, unknown or other
  misc_feature (408)..(412): n is a, c, g, or t
tcagtagtgtagatcacgaccggtgctcgatttagtagtcgcataaagggaaagggactggagtgggtctcaggtattggtggcagtggtgagacaacatactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggctacttccatctacactactgagcgggctggcaaggcgcatagnnnnn

SEQ ID NO: 61825 - DNA, 443 bp, Homo sapiens
  misc_feature: GYAE6OF02IY792.37.62.F07.1.454.CMB.1.raw
  modified_base (437)..(443): a, c, t, g, unknown or other
  misc_feature (437)..(443): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatcctccagagacaattccaagaacaccctgtctctgcaaatgaacaacctgagagccgaggacacggccctatattactgtaacgaaaatggcctacggatatgactactattgggactggtacttcgatctcgtgggccgtggcaccctggtcactgtctcctcagcctccaccaagggcccatcggtccttcccctggccgccctgcctccaggacgccacctccgagagcacagccggccctgggctgcctggtcaaggctactccatctacactactgagcgggctggcaggcgcatagnnnnnnn

SEQ ID NO: 61826 - DNA, 437 bp, Homo sapiens
  misc_feature: GYAE6OF02JMFWA.37.62.F07.1.454.CMB.1.raw
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (425)..(437): a, c, t, g, unknown or other
  misc_feature (425)..(437): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtctacgtcgtctcncncncctacgacgacgccngtccgtcctccgngccncctcgcncgagcnccacgcgagcncacgcgcgcgnggctcgcgtgacgacgtctactcatcacactcgngcgcgcgnggacgacggcanangnnnnnnnnnnnnn

SEQ ID NO: 61827 - DNA, 440 bp, Homo sapiens
  misc_feature: GYAE6OF02HXD39.37.62.F07.1.454.CMB.1.raw
  modified_base (434)..(440): a, c, t, g, unknown or other
  misc_feature (434)..(440): n is a, c, g, or t
tcagtagtgtagatcacgaccggtgctcgatttagtagtcgcataaagggaaagggactggagtgggtctcaggtattggtggcagtggtgagacaacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggagcacctccgagagcacagcggccctgggctgcctggtcaaggctacttccatcctacactactgagcgggctggcaaggcgcatagnnnnnnn

SEQ ID NO: 61828 - DNA, 434 bp, Homo sapiens
  misc_feature: GYAE6OF02IDLT2.37.62.F07.1.454.CMB.1.raw
  modified_base (358)..(358): a, c, t, g, unknown or other
  misc_feature (358)..(358): n is a, c, g, or t
  modified_base (432)..(434): a, c, t, g, unknown or other
  misc_feature (432)..(434): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaaagggcccatcggtcttccccctggcgccctgctccaggagcacctccgagngcacagcgccctgggctgcctggtcaaggactacttccatctacactactgagcgggctggcaaggcgcatagnnn

SEQ ID NO: 61829 - DNA, 451 bp, Homo sapiens
  misc_feature: GYAE6OF02FKNGP.37.62.F07.1.454.CMB.1.raw
  modified_base (431)..(451): a, c, t, g, unknown or other
  misc_feature (431)..(451): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctactccatctacactactgagcgggctggcaaggcgcatagnnnnnnnnnnnnnnnnnnnnn

SEQ ID NO: 61830 - DNA, 428 bp, Homo sapiens
  misc_feature: GYAE6OF02FVF6S.37.62.F07.1.454.CMB.1.raw
  modified_base (420)..(428): a, c, t, g, unknown or other
  misc_feature (420)..(428): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctctattactgtgcgagagatcagacggagtatagcagcagctctgactactggggccacggaaccctggtcaccgtctcctcagcctccaccaagggcccatcggtcttccccctggccaccctcctccaagagcacctctgggggcacagcggccctgggctgcctggtcaaggctacttccatctacactactgagcgggctggcaaggcgcatagnnnnnnnnn

SEQ ID NO: 61831 - DNA, 438 bp, Homo sapiens
  misc_feature: GYAE6OF02HAKFQ.37.62.F07.1.454.CMB.1.raw
  modified_base (431)..(438): a, c, t, g, unknown or other
  misc_feature (431)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctggcaggcgcatagnnnnnnnn

SEQ ID NO: 61832 - DNA, 437 bp, Homo sapiens
  misc_feature: GYAE6OF02I85LX.37.62.F07.1.454.CMB.1.raw
  modified_base (432)..(437): a, c, t, g, unknown or other
  misc_feature (432)..(437): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnn

SEQ ID NO: 61833 - DNA, 444 bp, Homo sapiens
  misc_feature: GYAE6OF02JGUQS.37.62.F07.1.454.CMB.1.raw
  modified_base (436)..(444): a, c, t, g, unknown or other
  misc_feature (436)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccttatattactgtgtgaagggacatctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnnnn

SEQ ID NO: 61834 - DNA, 438 bp, Homo sapiens
  misc_feature: GYAE6OF02JNE54.37.62.F07.1.454.CMB.1.raw
  modified_base (428)..(438): a, c, t, g, unknown or other
  misc_feature (428)..(438): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctctattactgtgcgagagatcagacggagtatagcagcagctctgactactggggccacggaaccctggtcaccgtctcctcagcctccaccaacgggcccatccggtcttcccccgtggtccaccctccctccaacgacgccacctcgtcggggcacgacgcggccctgggctgcctggtcaaggactactccatctacactactgagcggctggcaggcgcatgnnnnnnnnnnn

SEQ ID NO: 61835 - DNA, 435 bp, Homo sapiens
  misc_feature: GYAE6OF02GRYZL.37.62.F07.1.454.CMB.1.raw
  modified_base (431)..(435): a, c, t, g, unknown or other
  misc_feature (431)..(435): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggccgccctgctccaggacgcacctccgagagcacagcggccctgggctgcctggtcaaggctactccatctacactactgagcggctggcaaggcgcatagnnnnn

SEQ ID NO: 61836 - DNA, 437 bp, Homo sapiens
  misc_feature: GYAE6OF02I7907.37.62.F07.1.454.CMB.1.raw
  modified_base (427)..(427): a, c, t, g, unknown or other
  misc_feature (427)..(427): n is a, c, g, or t
  modified_base (432)..(437): a, c, t, g, unknown or other
  misc_feature (432)..(437): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgcctccaggagcacctccgagagcacagcggccctgggctgcctggtcaaggctacttccatctacactactgagcgggctggcaaggcgnatagnnnnnn

SEQ ID NO: 61837 - DNA, 436 bp, Homo sapiens
  misc_feature: GYAE6OF02HOBSN.37.62.F07.1.454.CMB.1.raw
  modified_base (428)..(428): a, c, t, g, unknown or other
  misc_feature (428)..(428): n is a, c, g, or t
  modified_base (432)..(436): a, c, t, g, unknown or other
  misc_feature (432)..(436): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagacgcacagccggccctgggctgcctggtcaaggctacttccatctacactactgagcgggctggcaggcgcntagnnnnn

SEQ ID NO: 61838 - DNA, 508 bp, Homo sapiens
  misc_feature: GYAE6OF02FOTJE.37.62.F07.1.454.CMB.1.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (454)..(454): a, c, t, g, unknown or other
  misc_feature (454)..(454): n is a, c, g, or t
  modified_base (477)..(478): a, c, t, g, unknown or other
  misc_feature (477)..(478): n is a, c, g, or t
  modified_base (480)..(508): a, c, t, g, unknown or other
  misc_feature (480)..(508): n is a, c, g, or t
tcagtagtgtagatcacgaccggtgctcgatttagtagtcgcataaagggaaagggaactggagggtgggtctcacggtaacttgggtggcagtggtgaggaccacatacgtaccgcagactccgtgaacggccgggttcacccatctccagagacgaatttccaagaacgaccctcgtctctggcaaaatgaaccaaacctgagacgccgagacacggccctactattactgtacgaaaatggcctacggatatgactactattgggactggtacttcgatctntggggccgtggnaccctggtctaacttggtctcctcagcctaccaccgaagggacccactacggtcttccccctggccgcccctgctccaggacgactaccgtaccgaggacgcacaagcggccctgggctgcctggtcaaggacttacttccatctacactactgacncgggcctggacaaggctcatagnntnnnnnnnnnnnnnnnnnnnnnnnnnnnnn

SEQ ID NO: 61839 - DNA, 444 bp, Homo sapiens
  misc_feature: GYAE6OF02HPHG8.37.62.F07.1.454.CMB.1.raw
  modified_base (432)..(444): a, c, t, g, unknown or other
  misc_feature (432)..(444): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggagcacctccgagagcacagcggccctggctgcctggtcaaggctacttccatctacactactgagcgggctgggcaaggcgcatagnnnnnnnnnnnnn

SEQ ID NO: 61840 - DNA, 445 bp, Homo sapiens
  misc_feature: GYAE6OF02JSRMN.37.62.F07.1.454.CMB.1.raw
  modified_base (430)..(445): a, c, t, g, unknown or other
  misc_feature (430)..(445): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccagggcccatcggtcttcccctggcgccctgctccaggacgcacctccgagagcacagcggccctgggctgcctggtcaaggctactccatctacactactgagcgggctggcaaggcgcatagnnnnnnnnnnnnnnnn

SEQ ID NO: 61841 - DNA, 441 bp, Homo sapiens
  misc_feature: GYAE6OF02JXB9T.37.62.F07.1.454.CMB.1.raw
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
  modified_base (429)..(441): a, c, t, g, unknown or other
  misc_feature (429)..(441): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagccctccaccaagggcccatccggtccttcccctggccgccctgcctccaggacgccacctccgagcgcacagcgcctggctgcctggcaggctactcatctacnctactgagcggctggcaggcncatagnnnnnnnnnnnnn

SEQ ID NO: 61842 - DNA, 445 bp, Homo sapiens
  misc_feature: GYAE6OF02J1WPW.37.62.F07.1.454.CMB.1.raw
  modified_base (428)..(445): a, c, t, g, unknown or other
  misc_feature (428)..(445): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcacctggtcactgtctcctcagcctcacccaagggcccatcggtcttccccctggcgcccctgctccaggagcacctccgagacgcacagcggccctgggctgcctggtcaaggctactcatctacactactgagcggctggcaaggcgcatagnnnnnnnnnnnnnnnnnn

SEQ ID NO: 61843 - DNA, 641 bp, Homo sapiens
  misc_feature: GYAE6OF02I07NB.37.62.F07.1.454.CMB.1.raw
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (576)..(576): a, c, t, g, unknown or other
  misc_feature (576)..(576): n is a, c, g, or t
tcagtagtgtagatcacgaccggtgctcgatttagtagtcgcataaagggaaaaggggaacgtggagtgggtctcctaggtacttgggtggtccaaggtcggtgagacctacgatactacgcagactccgtgaaggcccggttcgacctatcctccaggaagacgaattccaagacgtaccctgtctctagtcaaatgaacaacctgagagccgaggacaggcctagtattactggtacgaaatggcctaggactagtgacctatagttggtactggtacttcgacttctcgtagggtccgtaggcctacccgtggtcaacttggtcctcctcgacgtcccgtaccgaaccgtaacgggccccagttccgggtcccttccccctggccgcccgttgcctccgaggtacgtacctaccttccgaggacgccacgtacggaccgggtcccctggggtcctacggtcccttcggtaccgaaaggaccttaccgttaccgactacgtaacaccgtactgacgtcggctcggaccgtaaggccgacgacgttaagnacgngngacgcgtagtactatacgngtgtgagagagacgagacgagtcgcgcgacgaccgtaccgaccgtcgaccgtcgtcgtcgtcgtc

SEQ ID NO: 61844 - DNA, 445 bp, Homo sapiens
  misc_feature: GYAE6OF02GFFSF.37.62.F07.1.454.CMB.1.raw
  modified_base (433)..(445): a, c, t, g, unknown or other
  misc_feature (433)..(445): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagcctaggacacggccctatattactgtacgaaaatggcctacggatatgactactattgggactggtacttcgatctctgggccgtggcaccctggtcactgtctcctcagcctccaccaaggcccatcggtcttcccctgcgcccctgctccaggagcacctccgagagcacagcggcccctgggctgcctggtcaaggacctacttccatctacactacctgagcgggctggcaaggcgcagtagnnnnnnnnnnnnn

SEQ ID NO: 61845 - DNA, 425 bp, Homo sapiens
  misc_feature: GYAE6OF02HWKS3.37.62.F07.1.454.CMB.1.raw
  modified_base (419)..(425): a, c, t, g, unknown or other
  misc_feature (419)..(425): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctctattactgtgcgagagatcagacggagtatagcagcagctctgactactggggccacggaaccctggtcaccgtctcctcagcctccaccaagggccatcggtcttccccctggccaccctcctccaagagccacctctggggcacagcggcctgggctgcctggtcaaggactacttccatctacactactgagcgggctggcaaggcgcatagnnnnnnn

SEQ ID NO: 61846 - DNA, 444 bp, Homo sapiens
  misc_feature: GYAE6OF02HYI9N.37.62.F07.1.454.CMB.1.raw
  modified_base (357)..(357): a, c, t, g, unknown or other
  misc_feature (357)..(357): n is a, c, g, or t
  modified_base (434)..(444): a, c, t, g, unknown or other
  misc_feature (434)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctaggatatgactactattgggactggtacttcgatctctggggccgtggcaccctggtcactgtctcctcagcctccaccaagggcccatcggtcttcccctggccgccctgctccaggagcacctccgagngcacagcggccctgggctgcctggtccaaggactacttccatctacactactgagcgggctgggcaaggcgcatagnnnnnnnnnnn

SEQ ID NO: 61847 - DNA, 443 bp, Homo sapiens
  misc_feature: GYAE6OF02GKZSC.37.62.F07.1.454.CMB.1.raw
  modified_base (405)..(405): a, c, t, g, unknown or other
  misc_feature (405)..(405): n is a, c, g, or t
  modified_base (434)..(443): a, c, t, g, unknown or other
  misc_feature (434)..(443): n is a, c, g, or t
tcagtagtgtagatcacgaccggtgctcgatttagtagtcgcataaagggaaagggactggagtgggtctcaggtattggtggcagtggtgagaccacatactacgcagactccgtgaaggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggacgcacctccgagacgcacacgcggcccctgggctgcctggtcaaggctactccatctacnctactgagcgggctggcaaggcgcatagnnnnnnnnnn

SEQ ID NO: 61848 - DNA, 461 bp, Homo sapiens
  misc_feature: GYAE6OF02JAIBF.37.62.F07.1.454.CMB.1.raw
  modified_base (438)..(461): a, c, t, g, unknown or other
  misc_feature (438)..(461): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcacctggtcactgtctcctcagcctccacaagggcccatcggtcttcccctggccgccctgctccaggagcacctccgagacgcacagccggccctgggctgccctggtcaacggactacttccgatctacactactgagcggctggccaaggctcgactagcnnnnnnnnnnnnnnnnnnnnnnnn

SEQ ID NO: 61849 - DNA, 428 bp, Homo sapiens
  misc_feature: GYAE6OF02FTSTD.37.62.F07.1.454.CMB.1.raw
  modified_base (355)..(355): a, c, t, g, unknown or other
  misc_feature (355)..(355): n is a, c, g, or t
  modified_base (418)..(418): a, c, t, g, unknown or other
  misc_feature (418)..(418): n is a, c, g, or t
  modified_base (423)..(428): a, c, t, g, unknown or other
  misc_feature (423)..(428): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtctcccctggcgccctgctccaggacgcacctcgagagcacngcggccctgggctgcctggtcaaggactacttccatctacactactgagcggctggcaaggcncatgnnnnnn

SEQ ID NO: 61850 - DNA, 437 bp, Homo sapiens
  misc_feature: GYAE6OF02FZIJ9.37.62.F07.1.454.CMB.1.raw
  modified_base (432)..(437): a, c, t, g, unknown or other
  misc_feature (432)..(437): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnn

SEQ ID NO: 61851 - DNA, 436 bp, Homo sapiens; identical to SEQ ID NO: 61643
  misc_feature: GYAE6OF02HJN77.37.62.F07.1.454.CMB.1.raw
  modified_base (431)..(436): a, c, t, g, unknown or other
  misc_feature (431)..(436): n is a, c, g, or t

SEQ ID NO: 61852 - DNA, 438 bp, Homo sapiens
  misc_feature: GYAE6OF02F21PC.37.62.F07.1.454.CMB.1.raw
  modified_base (432)..(438): a, c, t, g, unknown or other
  misc_feature (432)..(438): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaggactacttccatctacactactgagcgggctggcaaggcgcatagnnnnnnn

SEQ ID NO: 61853 - DNA, 599 bp, Homo sapiens
  misc_feature: GYAE6OF02GU37F.37.62.F07.1.454.CMB.1.raw
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
tcagtagtgtagatcacgaccggtgctcgatttagtagtcgcataaagggggggtccctgagactctcctgtgcagcttcaggattcagctttagcagctacgccatgagctgggtccgccaggcctccagggaagggactggagtgggtctcaggtattggtggcagtggtgagaccacatactacgcagactccgtgaagggtccgttcaccatctccagagacaattccaagaaccaccctgtctctgacaaatgaacaacctgagagccgaggacaccggccctatattactgtaacgaaaatcggacctaacgggattagtacgtaactactagttcgggactggtacttcgatctcgtcggggcctggcctacccgtggtcacgtgtcctcctcacgtccctccaccgaacgggccctagtccggtcccttccccgtggccncccgtgcctccgagggacnccaccctccgacgacgccacgacggcccggtcccgtgggcctcgccgttggtaccaaacggtcctaccgttccattcccgtaaccacttacgtgacggccgggtctcggaccgtacgggcaccgtagtacgg

SEQ ID NO: 61854 - DNA, 437 bp, Homo sapiens; identical to SEQ ID NO: 61656
  misc_feature: GYAE6OF02FSD91.37.62.F07.1.454.CMB.1.raw
  modified_base (433)..(437): a, c, t, g, unknown or other
  misc_feature (433)..(437): n is a, c, g, or t

SEQ ID NO: 61855 - DNA, 438 bp, Homo sapiens
  misc_feature: GYAE6OF02F4BG9.37.62.F07.1.454.CMB.1.raw
  modified_base (431)..(438): a, c, t, g, unknown or other
  misc_feature (431)..(438): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnnnn

SEQ ID NO: 61856 - DNA, 448 bp, Homo sapiens
  misc_feature: GYAE6OF02HHGEZ.37.62.F07.1.454.CMB.1.raw
  modified_base (428)..(428): a, c, t, g, unknown or other
  misc_feature (428)..(428): n is a, c, g, or t
  modified_base (435)..(448): a, c, t, g, unknown or other
  misc_feature (435)..(448): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagccctccaccaagggcccatcggtccttccccctggccgccctgctccaggagcacctccgagacgcacagcgccctgggctgcctggtcaaggactcttccatctacactactgagcgggctggcaggcncgatagnnnnnnnnnnnnnn

SEQ ID NO: 61857 - DNA, 439 bp, Homo sapiens
  misc_feature: GYAE6OF02IOB8Y.37.62.F07.1.454.CMB.1.raw
  modified_base (429)..(439): a, c, t, g, unknown or other
  misc_feature (429)..(439): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaggctactccatctacactactgagcgggctggcaaggcgcatagnnnnnnnnnnn

SEQ ID NO: 61858 - DNA, 421 bp, Homo sapiens
  misc_feature: GYAE6OF02IVFA8.37.62.F07.1.454.CMB.1.raw
  modified_base (334)..(334): a, c, t, g, unknown or other
  misc_feature (334)..(334): n is a, c, g, or t
  modified_base (387)..(387): a, c, t, g, unknown or other
  misc_feature (387)..(387): n is a, c, g, or t
  modified_base (415)..(421): a, c, t, g, unknown or other
  misc_feature (415)..(421): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccagancacctctggggcacagcgccctggctgctggtcaaggactacttccatctacnctactgagcggctggcaaggcgcatagnnnnnnn

SEQ ID NO: 61859 - DNA, 441 bp, Homo sapiens
  misc_feature: GYAE6OF02G3Z67.37.62.F07.1.454.CMB.1.raw
  modified_base (432)..(441): a, c, t, g, unknown or other
  misc_feature (432)..(441): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnnnnnn

SEQ ID NO: 61860 - DNA, 520 bp, Homo sapiens
  misc_feature: GYAE6OF02G00PE.37.62.F07.1.454.CMB.1.raw
  modified_base (449)..(449): a, c, t, g, unknown or other
  misc_feature (449)..(449): n is a, c, g, or t
  modified_base (477)..(479): a, c, t, g, unknown or other
  misc_feature (477)..(479): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (492)..(494): a, c, t, g, unknown or other
  misc_feature (492)..(494): n is a, c, g, or t
  modified_base (496)..(501): a, c, t, g, unknown or other
  misc_feature (496)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (507)..(518): a, c, t, g, unknown or other
  misc_feature (507)..(518): n is a, c, g, or t
  modified_base (520)..(520): a, c, t, g, unknown or other
  misc_feature (520)..(520): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaaagaactaccctgtctctgtcaaatgaacaacctgagagccgaggacacggccctatattacgtgtgtgaagggacctctaggccccttatagcagcggctggtcctggtactttgacgactggggccagggaacccctggtcaccgtcgtccctcagccctccaccgaacgggccccaatccggtcctttccccccgtagggccgccccgtggccgttcccgagggacgcctacccttccgaggacgcacagcggccctgggctgcctggtcaacggcctactccgatctacactacngacgcgggctggccaaggcgacatagcnnncngancangcngnnngnnnnnngngngnnnnnnnnnnnngn

SEQ ID NO: 61861 - DNA, 435 bp, Homo sapiens
  misc_feature: GYAE6OF02HXROT.37.62.F07.1.454.CMB.1.raw
  modified_base (345)..(345): a, c, t, g, unknown or other
  misc_feature (345)..(345): n is a, c, g, or t
  modified_base (427)..(435): a, c, t, g, unknown or other
  misc_feature (427)..(435): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggancacctcgagagcacagcggccctgggctgcctggcaaggactacttcatctacactactgagcggctggcaaggcgcatagnnnnnnnnn

SEQ ID NO: 61862 - DNA, 460 bp, Homo sapiens
  misc_feature: GYAE6OF02GRSFR.37.62.F07.1.454.CMB.1.raw
  modified_base (346)..(346): a, c, t, g, unknown or other
  misc_feature (346)..(346): n is a, c, g, or t
  modified_base (433)..(434): a, c, t, g, unknown or other
  misc_feature (433)..(434): n is a, c, g, or t
  modified_base (436)..(460): a, c, t, g, unknown or other
  misc_feature (436)..(460): n is a, c, g, or t
tcagtagtgtagatcacgaccggtgctcgatttagtagtcgcataaagggaaggggactggagtgggtctcaggtattggtgggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggncacctccgagagcacgagccggccctgggctgcctggtcaaggactactcatctacactatgagcgggctggcaagggcgcattagnngnnnnnnnnnnnnnnnnnnnnnnnnn

SEQ ID NO: 61863 - DNA, 445 bp, Homo sapiens
  misc_feature: GYAE6OF02I3OBV.37.62.F07.1.454.CMB.1.raw
  modified_base (430)..(445): a, c, t, g, unknown or other
  misc_feature (430)..(445): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggtcgtggcaccctggtcactgtctcctcagcctccaccaagggcccatcggtcttccccctggcgccctgctccaggagcacctccgagagcacagcggccctgggctgcctggtcaaggctactcatctacactactgagcgggctggcaaggcgcatagnnnnnnnnnnnnnnnn

SEQ ID NO: 61864 - DNA, 529 bp, Homo sapiens
  misc_feature: GYAE6OF02HHUXO.37.62.F07.1.454.CMB.1.raw
  modified_base (398)..(398): a, c, t, g, unknown or other
  misc_feature (398)..(398): n is a, c, g, or t
  modified_base (518)..(529): a, c, t, g, unknown or other
  misc_feature (518)..(529): n is a, c, g, or t
tcagtagtgtagatcacgaccggtgctcgatttagtagtcgcataaagggaagggactggagtgggtctcaggtattggtggcagtggtgagaccacatactacgcagacctccgtgaagggtccggttcaccatcctccagagacaattccaaagaaccaccctgtctctgacaaatgaaccaacctgagacgccgaggacaccggccctatattactgtaacgaaaatggcctacggatatgactactagttggactggtacttcgatctcgtcggggccgtggccacccgtggtcacgtgtcctcctcacgccctccaacccgaacgggcccctagtccggttcccttcccccgtcggccgtcccctgcctcccgaggacgccacccgtccgagngccacacggcccggcccgtgggcctcggtccgtgggtaccaaacgggtaccttaccgttcccattacctacctaactacctggacggcgggtccgtgggaccgaagggccgacagtacgnnnnnnnnnnnn

SEQ ID NO: 61865 - DNA, 458 bp, Homo sapiens
  misc_feature: GYAE6OF02IVJ1Q.37.62.F07.1.454.CMB.1.raw
  modified_base (211)..(211): a, c, t, g, unknown or other
  misc_feature (211)..(211): n is a, c, g, or t
  modified_base (329)..(329): a, c, t, g, unknown or other
  misc_feature (329)..(329): n is a, c, g, or t
  modified_base (412)..(412): a, c, t, g, unknown or other
  misc_feature (412)..(412): n is a, c, g, or t
  modified_base (443)..(458): a, c, t, g, unknown or other
  misc_feature (443)..(458): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattacngtaacgaaaatggcctacggatatgactactattgggactggtacttcgatctctggggcctggcaccctggtcactgtctcctcagcctccaccaagggccccatcggtcttccccnggccgccctgctccaggagcacctccgagacgcacagcggccctgggctgcctggtcaaggacctacgttcccagtcctaacnctactgagcgggctggcaaggcgcagtacgnnnnnnnnnnnnnnnn

SEQ ID NO: 61866 - DNA, 548 bp, Homo sapiens
  misc_feature: GYAE6OF02G3XJZ.37.62.F07.1.454.CMB.1.raw
  modified_base (123)..(123): a, c, t, g, unknown or other
  misc_feature (123)..(123): n is a, c, g, or t
  modified_base (270)..(270): a, c, t, g, unknown or other
  misc_feature (270)..(270): n is a, c, g, or t
  modified_base (474)..(474): a, c, t, g, unknown or other
  misc_feature (474)..(474): n is a, c, g, or t
  modified_base (523)..(548): a, c, t, g, unknown or other
  misc_feature (523)..(548): n is a, c, g, or t
tcagtagtgtagatcacgaccggtgctcgatttagtagtcgcataaagggaaagggaacgtaggagtgggtcgtcgaggtattgggtggcagtggtgagaccacatactacgcagactccgtnaagggccggttcaccatctccagagacaattccaagaacaccctgtctctgcaaatgaacaacctgagagccgaggacaggccctatattactgtacgaaaattggacctacggatatgactatattgggactggtacttcgattcnctgggccgtggcaccctggtcactgtctccgtcagccctcctaccaagggtccccatccggttcctccccctggtccgccccttgcctccccaggtacgcaaccctccgaacgtgccacagccgggccctccggggcttcggaccctgggtaccaaggtacctacgttacccatcctaacacctacgtacgtcgggacggtcgnggtaccgaaacggcgacccggtaataacgggctcagcttgcaggttccnnnnnnnnnnnnnnnnnnnnnnnnnn

SEQ ID NO: 61867 - DNA, 444 bp, Homo sapiens
  misc_feature: GYAE6OF02ILPMC.37.62.F07.1.454.CMB.1.raw
  modified_base (350)..(350): a, c, t, g, unknown or other
  misc_feature (350)..(350): n is a, c, g, or t
  modified_base (418)..(418): a, c, t, g, unknown or other
  misc_feature (418)..(418): n is a, c, g, or t
  modified_base (435)..(444): a, c, t, g, unknown or other
  misc_feature (435)..(444): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggacncacctccgagagcacagccggcccgtggctgcctggtcaaggctactcatctacactactgagcgggntggcgaggcgcatacgnnnnnnnnnn

SEQ ID NO: 61868 - DNA, 441 bp, Homo sapiens
  misc_feature: GYAE6OF02IZAM8.37.62.F07.1.454.CMB.1.raw
  modified_base (422)..(441): a, c, t, g, unknown or other
  misc_feature (422)..(441): n is a, c, g, or t
tcagtagtgtagatcacgaccggtgctcgatttagtagtcgcataaagggaaagggacgtggagtgggtctcaggtattggtggcagtggtgagaccacatactacgcagactccgtgaagggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggccccatcggtcttccccctggcaccctcctccaagagccacctctgggggcacagcggcctgggctgcctggtcaaggactacttccatctacactactgagcgggctggcaagcgcatagnnnnnnnnnnnnnnnnnnnn

SEQ ID NO: 61869 - DNA, 454 bp, Homo sapiens
  misc_feature: GYAE6OF02IRRDB.37.62.F07.1.454.CMB.1.raw
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (437)..(437): a, c, t, g, unknown or other
  misc_feature (437)..(437): n is a, c, g, or t
  modified_base (443)..(454): a, c, t, g, unknown or other
  misc_feature (443)..(454): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagccctccaccaagggcccatcggtccttccccgtggccnccctgcctccaggacncacctccgagacgcacagccggccctgggctgcctggtcaaggactacttccatcctacactactggagcgggctggcaagggcncatagnnnnnnnnnnnn

SEQ ID NO: 61870 - DNA, 539 bp, Homo sapiens
  misc_feature: GYAE6OF02HDY2V.37.62.F07.1.454.CMB.1.raw
tcagtagtgtagatcacgaccggtgctcgatttagtagtcgcataaagggggggtccctgagactctcctgtgcagcttcaggattcagctttagcagctacgccatgagctgggtccgccaggctccagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctctggggccgtggccaccctggtcactgtctcctcacgcctccaccgaacgggcccatccggtccttcccccgtggccgccctgcctcccgaggacgccaccctccgagacgccacgagccggcccgtgggcctcgcctggtcaaggacctacttcatctacactacgtgacgcgggctggacaggcgacatacg

SEQ ID NO: 61871 - DNA, 437 bp, Homo sapiens
  misc_feature: GYAE6OF02GXDW5.37.62.F07.1.454.CMB.1.raw
  modified_base (431)..(437): a, c, t, g, unknown or other
  misc_feature (431)..(437): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagacgcacagcggccctgggctgcctggtcaaggctacttccatctacactactgagcgggctggcaggcgcatagnnnnnnn

SEQ ID NO: 61872 - DNA, 440 bp, Homo sapiens
  misc_feature: GYAE6OF02G7YBP.37.62.F07.1.454.CMB.1.raw
  modified_base (429)..(440): a, c, t, g, unknown or other
  misc_feature (429)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaggctacttccatctacactactgagcgggctggcaggcgcatagnnnnnnnnnnnn

SEQ ID NO: 61873 - DNA, 451 bp, Homo sapiens
  misc_feature: GYAE6OF02IOVZM.37.62.F07.1.454.CMB.1.raw
  modified_base (433)..(433): a, c, t, g, unknown or other
  misc_feature (433)..(433): n is a, c, g, or t
  modified_base (440)..(451): a, c, t, g, unknown or other
  misc_feature (440)..(451): n is a, c, g, or t
tcagtagtgtagatcacgaccggtgctcgatttagtagtcgcataaaggaaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtccttccccctggccgccctgcctccaggagcacctccgagagcacacgcggccctgggctgcctggtcaacggctactccatcctacactactgagcgggctcggcaagggcncagtagnnnnnnnnnnnn

SEQ ID NO: 61874 - DNA, 439 bp, Homo sapiens
  misc_feature: GYAE6OF02GM074.37.62.F07.1.454.CMB.1.raw
  modified_base (430)..(439): a, c, t, g, unknown or other
  misc_feature (430)..(439): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactctgagcgggctggcaaggcgcatagnnnnnnnnnn

SEQ ID NO: 61875 - DNA, 473 bp, Homo sapiens
  misc_feature: GYAE6OF02H253S.37.62.F07.1.454.CMB.1.raw
  modified_base (445)..(445): a, c, t, g, unknown or other
  misc_feature (445)..(445): n is a, c, g, or t
  modified_base (448)..(473): a, c, t, g, unknown or other
  misc_feature (448)..(473): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctctattactgtgcgagagatcagacggagtatagcagcagctctgactactggggccacggaaccctggtcaccgtctcctcagcctccaccaacgggcccagtccggtccttccccctggtccacccctccctccaacgacgccacctccgtggggccacgagccggccctgggcctcgcctggtcaaggcctaccttccactctacactactggacgcgggctcggcaaaggcgacagtagngcnnnnnnnnnnnnnnnnnnnnnnnnnn

SEQ ID NO: 61876 - DNA, 443 bp, Homo sapiens
  misc_feature: GYAE6OF02F0QX8.37.62.F07.1.454.CMB.1.raw
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
  modified_base (438)..(443): a, c, t, g, unknown or other
  misc_feature (438)..(443): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggccccatcggtccttccccctggccgcccctgcctccaggagccacctccgagagcacagccggccctgggctgcctggtcaaggctacttccatctacnctactgagcgggctggcaaggcncatagnnnnnn

SEQ ID NO: 61877 - DNA, 440 bp, Homo sapiens
  misc_feature: GYAE6OF02HP60V.37.62.F07.1.454.CMB.1.raw
  modified_base (432)..(440): a, c, t, g, unknown or other
  misc_feature (432)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctcgagagcacagcggccctgggctgcctggtcaaggctacttccatctacactactgagcgggctgggcaagggcgcatagnnnnnnnnn

SEQ ID NO: 61878 - DNA, 446 bp, Homo sapiens
  misc_feature: GYAE6OF02FOS75.37.62.F07.1.454.CMB.1.raw
  modified_base (435)..(446): a, c, t, g, unknown or other
  misc_feature (435)..(446): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacccctggtcactgtctcctcagcctccaccaagggcccatcggtcttccccctggcgcccctgctccaggagcacctccgagagcacagcggccctgggctgcctggtcaaggactacttccatctacactactgagcgggctggcaaggcgcatagnnnnnnnnnnnn

SEQ ID NO: 61879 - DNA, 444 bp, Homo sapiens
  misc_feature: GYAE6OF02HP4N7.37.62.F07.1.454.CMB.1.raw
  modified_base (437)..(444): a, c, t, g, unknown or other
  misc_feature (437)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggccccatccggtcttccccctggccgcccctgcctccgaggacgcacctccgagagcacagcgccctgggctgcctggtcaaggctacttccatcacactactgagcgggctggcaaggcgcatagnnnnnnnn

SEQ ID NO: 61880 - DNA, 465 bp, Homo sapiens
  misc_feature: GYAE6OF02HJ67G.37.62.F07.1.454.CMB.1.raw
  modified_base (356)..(356): a, c, t, g, unknown or other
  misc_feature (356)..(356): n is a, c, g, or t
  modified_base (409)..(409): a, c, t, g, unknown or other
  misc_feature (409)..(409): n is a, c, g, or t
  modified_base (436)..(465): a, c, t, g, unknown or other
  misc_feature (436)..(465): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacgccctatattactgtacgaaaatggcctacggatatgactactattgggactggtacttcgatctctggggccgtggcaccctggtcactgctcctcagcctccaccaagggccccatccggtctcccctggcgccctgctccaggagccacctccganacggcacagcggccctgggctgcctggtcaaggactacttccatctacactangagcgggctggcaagggcgacatagcnnnnnnnnnnnnnnnnnnnnnnnnnnnnnn

SEQ ID NO: 61881 - DNA, 445 bp, Homo sapiens
  misc_feature: GYAE6OF02JDJUG.37.62.F07.1.454.CMB.1.raw
  modified_base (432)..(445): a, c, t, g, unknown or other
  misc_feature (432)..(445): n is a, c, g, or t
tcagtagtgtagatcacgaccggtgctcgatttagtagtcgcataaagggaaagggactggagtgggtctcaggtattggtggcagtggtgagaccacatactacgcagactccgtgaaggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatcctacactactgagcgggctggcaaggcgcatagnnnnnnnnnnnnnn

SEQ ID NO: 61882 - DNA, 477 bp, Homo sapiens
  misc_feature: GYAE6OF02GV4BI.37.62.F07.1.454.CMB.1.raw
  modified_base (184)..(184): a, c, t, g, unknown or other
  misc_feature (184)..(184): n is a, c, g, or t
  modified_base (274)..(274): a, c, t, g, unknown or other
  misc_feature (274)..(274): n is a, c, g, or t
  modified_base (409)..(409): a, c, t, g, unknown or other
  misc_feature (409)..(409): n is a, c, g, or t
  modified_base (448)..(477): a, c, t, g, unknown or other
  misc_feature (448)..(477): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctganagccgaggacacggccctatattactgtacgaaaatggcctacggatatgactactattgggactggtacttcgatctctgggcgtggcnccctggtcactgtctcctcagcctccaccacgggcccatcgtcctccccctgccgccctcgcctccaggacgccacctccgagacgcacagccggccctgggcctgccgtgcgacggactacgttccatcctacncctactcgagcgggctgggaccaaggcgacgatacgcgnnnnnnnnnnnnnnnnnnnnnnnnnnnnnn

SEQ ID NO: 61883 - DNA, 464 bp, Homo sapiens
  misc_feature: GYAE6OF02GVVVK.37.62.F07.1.454.CMB.1.raw
  modified_base (452)..(464): a, c, t, g, unknown or other
  misc_feature (452)..(464): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacactctgtatctgcaaatgaacagcctgagtgccgaggacacggccctatattattgtgcgaaatgtggggggagtgggggctactcctggcgttttgactactgggggccagggagccctggtcaccgtctcctcagccctcaccaagggcccatccggtccttcccccgtggccgccctgcctccaggacgccaccgtccgagacgccacgacggccggcccgtggggcctggcctgggtacaaggactacttcccatctacactactgacggcggctggacaaggcgcagtagnnnnnnnnnnnnn

SEQ ID NO: 61884 - DNA, 620 bp, Homo sapiens
  misc_feature: GYAE6OF02JKV9P.37.62.F07.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (558)..(558): a, c, t, g, unknown or other
  misc_feature (558)..(558): n is a, c, g, or t
  modified_base (568)..(568): a, c, t, g, unknown or other
  misc_feature (568)..(568): n is a, c, g, or t
  modified_base (585)..(586): a, c, t, g, unknown or other
  misc_feature (585)..(586): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
tcagtagtgtagatcacgaccggtgctcgatttagtagtcgcataaagggtaaaggggactggagtagggtcgtcaggtattgggtggcgagtggtgaggaccacatactaacgcagactccgttgaagggccggtttcaccatctccagggacaagttccaagaacacactgtctctgcaaatgaacagcctgagngtcgaggacacggccttatattactgtgtgaagggacctntacgccctttanagcagcggcttggtcctcggtactttgacgacttgggccagggaaccctggtcacggtctacgtcagcctccacgaacgggcccatcggtcttccccgtggccgcccgtgccttccgacggacgtccacccgtcgacgcgccacgtacgcccgggtaccctcgggcctacgtccccttcgggaccgtaaacgggccttttaaccgttcccgtacgtttacccttaaccgaccgtttaaccgtacggtacggaccggggtccggtagggaccctaacgggtccgtacgtaacgttacggcgtacagctanctacgttacnctcgtgcacgcagacgnntcgacgctgcgcgtcgcncncgtctctctntntc

SEQ ID NO: 61885 - DNA, 440 bp, Homo sapiens
  misc_feature: GYAE6OF02GOVF6.37.62.F07.1.454.CMB.1.raw
  modified_base (433)..(440): a, c, t, g, unknown or other
  misc_feature (433)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacccctggtcactgtctcctcagcctccaccaagggcccatcggtcttccccctggcgccctgctccaggagcacctccgagacgcacagcggccctgggctgcctggtcaaggctactccatctacactactgagcgggctggcaaggcgcatagnnnnnnnn

SEQ ID NO: 61886 - DNA, 440 bp, Homo sapiens
  misc_feature: GYAE6OF02G8XDP.37.62.F07.1.454.CMB.1.raw
  modified_base (430)..(440): a, c, t, g, unknown or other
  misc_feature (430)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaggcgcatagnnnnnnnnnnn

SEQ ID NO: 61887 - DNA, 428 bp, Homo sapiens
  misc_feature: GYAE6OF02HJMU9.37.62.F07.1.454.CMB.1.raw
  modified_base (332)..(332): a, c, t, g, unknown or other
  misc_feature (332)..(332): n is a, c, g, or t
  modified_base (417)..(428): a, c, t, g, unknown or other
  misc_feature (417)..(428): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctctattactgtgcgagagatcagacggagtatagcagcagctctgactactggggccacggaaccctggtcaccgtctcctcagcctccaccaagggcccatcggtctcccctggcaccctcctccaagngcacctctggggcacagcggcctgggctgcctggtcaaggactacttccatctacactactgagcgggctggcaaggcgcatagnnnnnnnnnnnn

SEQ ID NO: 61888 - DNA, 472 bp, Homo sapiens
  misc_feature: GYAE6OF02HEOC6.37.62.F07.1.454.CMB.1.raw
  modified_base (448)..(449): a, c, t, g, unknown or other
  misc_feature (448)..(449): n is a, c, g, or t
  modified_base (451)..(472): a, c, t, g, unknown or other
  misc_feature (451)..(472): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacagtctgagagctgaggacacggccttgtattactgtgcaaaggatcagtatcaactggctgtcaatacttttgatatttggggccaaggcacaatggtcagcgtctcttcagcctccaccaagggccccatccggtccttccccctggccacccctcctccaagacgccacctcgtcgggggcacgacgccgggccctcgggctcgccgtggtccaaacggctacgttccatcctacactactgacggcgggctggcaaggtcgcatacgnncnnnnnnnnnnnnnnnnnnnnnn

SEQ ID NO: 61889 - DNA, 446 bp, Homo sapiens
  misc_feature: GYAE6OF02GAJ7S.37.62.F07.1.454.CMB.1.raw
  modified_base (436)..(446): a, c, t, g, unknown or other
  misc_feature (436)..(446): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattcccgggatggtacttcgatctctggggccgtggcaccctggtcactgtctctcagcctccaccaagggcccatcggtcttcccctggcgccctgctccaggagccacctccgagacgcacagcggccctgggctgcctggtcaaggctacgttccatctacactactgagcgggctggcaagggcgacatagnnnnnnnnnnn

SEQ ID NO: 61890 - DNA, 440 bp, Homo sapiens
  misc_feature: GYAE6OF02F7R00.37.62.F07.1.454.CMB.1.raw
  modified_base (346)..(346): a, c, t, g, unknown or other
  misc_feature (346)..(346): n is a, c, g, or t
  modified_base (427)..(427): a, c, t, g, unknown or other
  misc_feature (427)..(427): n is a, c, g, or t
  modified_base (432)..(440): a, c, t, g, unknown or other
  misc_feature (432)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggancacctccgagagcacagcgccctgggctgcctggtcaaggacctacttccatctacactactgagcgggctggcaaggcgnatagnnnnnnnnn

SEQ ID NO: 61891 - DNA, 517 bp, Homo sapiens
  misc_feature: GYAE6OF02JM8FG.37.62.F07.1.454.CMB.1.raw
  modified_base (343)..(343): a, c, t, g, unknown or other
  misc_feature (343)..(343): n is a, c, g, or t
  modified_base (486)..(517): a, c, t, g, unknown or other
  misc_feature (486)..(517): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagccctccaaccgaagggccccagtccggtccttcccccgtggccnccctgcctaccgaggacgccaccctccgagacgccacacgccggcccgtgggctcggcccgtaggtacaaacgggtacctacgttaccagtacctaacgactacgtcgaggcgggctacggacgaaacggccactaagtcgannnnnnnnnnnnnnnnnnnnnnnnnnnnnnnn

SEQ ID NO: 61892 - DNA, 449 bp, Homo sapiens
  misc_feature: GYAE6OF02JVXL2.37.62.F07.1.454.CMB.1.raw
  modified_base (352)..(352): a, c, t, g, unknown or other
  misc_feature (352)..(352): n is a, c, g, or t
  modified_base (439)..(439): a, c, t, g, unknown or other
  misc_feature (439)..(439): n is a, c, g, or t
  modified_base (441)..(449): a, c, t, g, unknown or other
  misc_feature (441)..(449): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtccttcccctggccgccctgcctccagganccacctccgagacgcacacggcggccctgggcctcgcctggtcaaggctacttccatctacactactgagcggctggcaaggcgcangnnnnnnnnn

SEQ ID NO: 61893 - DNA, 454 bp, Homo sapiens
  misc_feature: GYAE6OF02HEKPB.37.62.F07.1.454.CMB.1.raw
  modified_base (444)..(454): a, c, t, g, unknown or other
  misc_feature (444)..(454): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggccccatccggtcttccccctggccgcccctgcctccaggacgccaccctccgagacgcacagccggccctgggctcgcctggcaaggactacttccatctacactactgagcgggctggcaaggcgacatagnnnnnnnnnnn

SEQ ID NO: 61894 - DNA, 707 bp, Homo sapiens
  misc_feature: GYAE6OF02INFWU.37.62.F07.1.454.CMB.1.raw
  modified_base (351)..(351): a, c, t, g, unknown or other
  misc_feature (351)..(351): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (604)..(604): a, c, t, g, unknown or other
  misc_feature (604)..(604): n is a, c, g, or t
tcagtagtgtagatcacgaccggtgctcgattttagtagtcgcataaaagggtaaaggggtacggtcggacgtggggtctcaagggtaattggtgggacagtcggttgaggtaccaccacttactacgcgaggactccgtgaacgggccggttcaccgatctcccaggagacaaattccaagaaacgaccctggtcctctgcgaaatggaacctaaccgtgacgagcccgaggaccacggccctatattactgtacgaaaatcggcctacggatatgtacttacttagttggggactgggtaccttcgatcctcgtgggggccggtggcaccctggtcacgtgtctcctcngcctcgaccgaacgggtccctagtccggtccttcccccgtgccnccctgctaccgaggacnccacctccgagtacgaccgacgacggccggacccgtcgggacctcggtcccgtttcggtaccgaaacggtacctttaccgttaccgtacgttacgtaacccgaccgttaccgtcggaaggccggggtaccgttacgggtaccgtaacgggccgtacgacggttaaggcgagtactagtacgtgttagttagngttaggtaattccgactaccgtaagtacgtcggcgggtactcgaacgttcccgggtaggaccgtagtacgttcggacgtaccgtccgtacgtccgtacgcccg

SEQ ID NO: 61895 - DNA, 471 bp, Homo sapiens
  misc_feature: GYAE6OF02IVUIB.37.62.F07.1.454.CMB.1.raw
  modified_base (338)..(338): a, c, t, g, unknown or other
  misc_feature (338)..(338): n is a, c, g, or t
  modified_base (442)..(442): a, c, t, g, unknown or other
  misc_feature (442)..(442): n is a, c, g, or t
  modified_base (449)..(471): a, c, t, g, unknown or other
  misc_feature (449)..(471): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctaggatatgactactattgggactggtacttcgatctctggggccgtggcaccctggtcacgtgtctcctcacgcctccaccaagggcccagtcggtccttccccctggtccncccctgcctccgaggtcgccacctccgagacgcacgagccggcctgggctgccgtggtcaaggccttactccagtctacactactgagcgggctggacaaggcncatacgnnnnnnnnnnnnnnnnnnnnnnn

SEQ ID NO: 61896 - DNA, 437 bp, Homo sapiens; identical to SEQ ID NO: 61656
  misc_feature: GYAE6OF02FKEDB.37.62.F07.1.454.CMB.1.raw
  modified_base (433)..(437): a, c, t, g, unknown or other
  misc_feature (433)..(437): n is a, c, g, or t

SEQ ID NO: 61897 - DNA, 451 bp, Homo sapiens
  misc_feature: GYAE6OF02I2OCK.37.62.F07.1.454.CMB.1.raw
  modified_base (328)..(328): a, c, t, g, unknown or other
  misc_feature (328)..(328): n is a, c, g, or t
  modified_base (438)..(438): a, c, t, g, unknown or other
  misc_feature (438)..(438): n is a, c, g, or t
  modified_base (443)..(451): a, c, t, g, unknown or other
  misc_feature (443)..(451): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccacaagggcccatcggtcttccccnggccgccctgcctccaggacgccaccgtccgagacgccacacgccggccctggggctgcctggtcaaggtcctacttccattctacactactgagcggctaggcaaggcncatgnnnnnnnnn

SEQ ID NO: 61898 - DNA, 508 bp, Homo sapiens
  misc_feature: GYAE6OF02FVLYC.37.62.F07.1.454.CMB.1.raw
  modified_base (272)..(272): a, c, t, g, unknown or other
  misc_feature (272)..(272): n is a, c, g, or t
  modified_base (468)..(469): a, c, t, g, unknown or other
  misc_feature (468)..(469): n is a, c, g, or t
  modified_base (472)..(474): a, c, t, g, unknown or other
  misc_feature (472)..(474): n is a, c, g, or t
  modified_base (478)..(479): a, c, t, g, unknown or other
  misc_feature (478)..(479): n is a, c, g, or t
  modified_base (481)..(482): a, c, t, g, unknown or other
  misc_feature (481)..(482): n is a, c, g, or t
  modified_base (484)..(484): a, c, t, g, unknown or other
  misc_feature (484)..(484): n is a, c, g, or t
  modified_base (486)..(491): a, c, t, g, unknown or other
  misc_feature (486)..(491): n is a, c, g, or t
  modified_base (493)..(493): a, c, t, g, unknown or other
  misc_feature (493)..(493): n is a, c, g, or t
  modified_base (495)..(508): a, c, t, g, unknown or other
  misc_feature (495)..(508): n is a, c, g, or t
tcagtagtgtagatcacgaccggtgctcgattttagtagtcgcataaaagggaagggggactggagtgggtctcaggtattggtggcagtggtgagaccgacatactacgcagactccggtgaagggccggttcaccatctccagagacaattccaagaacaccctgtctctgcaaatgaacaacctgagacgccgaggacacggccctatattactgtaacgaaaaatggcctacggatatgactactattgggactggtacttcgatctntgggccgtggcaccctggtcactgtctcctcacgcctaccaccgaacgggccccatccggtccttcccccgtggccgccctgccttccgaggagccaccgtccgagagcacagcgggccctgggctcgccgtggtcaaggtcctacttccatctacactacgtgacggcggcgtggacgaagggcgacaattagcnnctnnntagnncnncncnnnnnngngnnnnnnnnnnnnnn

SEQ ID NO: 61899 - DNA, 570 bp, Homo sapiens
  misc_feature: GYAE6OF02IFTQ3.37.62.F07.1.454.CMB.1.raw
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
tcagtagtgtagatcacgaccggtgctcgatttagtagtcgcataaaagggggggtccctgagactctcctgtgcagcttcaggattcagctttagcagctacgccatgagctgggtccgccaggctccagggaagggactgggagtgggtctcagttattggtggcagtggtgagaccacatactacgcagactccgtgaagggccggttcaccatctccagagacaattccaaagaaccaccctgtctctgcaaatgaaaccaacctgagagccgaggacacggccctatattactgtaacgaaaatggcctaacggatatgactactattgggactggtacttcgatctacgtggggcgtggccacctggtcactgtctcctcacgcctccaccacggccatccggtctcccctgcgccctgcctcaggacncacctccgagcncacgagccggcccgtgggctcgccctggtaccaagggtacctaccttcccgaacttccgtaaccaccttaccgtggtaacggcccggggtactcgggtaccgaacgggccgtccgaagtacgg

SEQ ID NO: 61900 - DNA, 501 bp, Homo sapiens
  misc_feature: GYAE6OF02GI3B0.37.62.F07.1.454.CMB.1.raw
  modified_base (478)..(501): a, c, t, g, unknown or other
  misc_feature (478)..(501): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtgtgaagggacctctagccccttatagcagcggctggtcctggtactttgacgactggggccagggaaccctggtcaccgtctcctcagcctccaccaagggcccatccggtccttccccctggccgccctgcctccagggcgccacctccggagacgcacacggccggcccgtgggcctcgcccgtggtaccaacgggtacctacttcccagtcctaccacttacctggacggccggggtctcgggacaacgggcgacagtagcnnnnnnnnnnnnnnnnnnnnnnnn

SEQ ID NO: 61901 - DNA, 439 bp, Homo sapiens
  misc_feature: GYAE6OF02GOE6H.37.62.F07.1.454.CMB.1.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (429)..(439): a, c, t, g, unknown or other
  misc_feature (429)..(439): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcnccctgctccaggngcacctccgagngcacagcggccctgggctgcctggtcaaggctacttccatctacactactgagcgggctggcaggcgcatagnnnnnnnnnnn

SEQ ID NO: 61902 - DNA, 497 bp, Homo sapiens
  misc_feature: GYAE6OF02I774A.37.62.F07.1.454.CMB.1.raw
  modified_base (467)..(497): a, c, t, g, unknown or other
  misc_feature (467)..(497): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattactgtacgaaaatggcctacggatatgactactattgggactggtactgatctctggggctggcaccctggtcactgtctcctcagccctccacgaacgggccccattccggtccttcccctggcccgccctgtcctccaggacgccacctccggagacgcacagccgccgtgggcctagcccgtggtacgaacggactacgtttccagttactaccacgtacgtgacggcggtctggcgaagggcgtacacgtagcagnnnnnnnnnnnnnnnnnnnnnnnnnnnnnnn

SEQ ID NO: 61903 - DNA, 444 bp, Homo sapiens
  misc_feature: GYAE6OF02GK4PG.37.62.F07.1.454.CMB.1.raw
  modified_base (434)..(444): a, c, t, g, unknown or other
  misc_feature (434)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatctacactactgagcgggctgggcaagggcgcatagnnnnnnnnnnn

SEQ ID NO: 61904 - DNA, 466 bp, Homo sapiens
  misc_feature: GYAE6OF02H10GP.37.62.F07.1.454.CMB.1.raw
  modified_base (444)..(466): a, c, t, g, unknown or other
  misc_feature (444)..(466): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattactgtacgaaaatggcctacggatatgactactattgggactggtacttcgatctcgtggggccgtggcaccctggtcactgtctcctcagccctcaccgaagggcccatcggtccttcccccgtggccgccctgctccaggacgcacctccgagcgcacagccggcccgtgggctcgccgtggacaaggcttactccatctacactacgtgacgcgggctggcaaggcgcagtagnnnnnnnnnnnnnnnnnnnnnnn

SEQ ID NO: 61905 - DNA, 450 bp, Homo sapiens
  misc_feature: GYAE6OF02HN80X.37.62.F07.1.454.CMB.1.raw
  modified_base (329)..(329): a, c, t, g, unknown or other
  misc_feature (329)..(329): n is a, c, g, or t
  modified_base (430)..(430): a, c, t, g, unknown or other
  misc_feature (430)..(430): n is a, c, g, or t
  modified_base (435)..(450): a, c, t, g, unknown or other
  misc_feature (435)..(450): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtccttccccnggccgccctgctccgaggacgcacctccgagagcacagcggccctgggctgcctggcaaggactacttccactacactactgagcgggctggcaaggcganatagnnnnnnnnnnnnnnnn

SEQ ID NO: 61906 - DNA, 489 bp, Homo sapiens
  misc_feature: GYAE6OF02GGRZK.37.62.F07.1.454.CMB.1.raw
  modified_base (436)..(436): a, c, t, g, unknown or other
  misc_feature (436)..(436): n is a, c, g, or t
  modified_base (471)..(489): a, c, t, g, unknown or other
  misc_feature (471)..(489): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtccactgtctcctcagcctccaccgaacgggcccagtccggtccttcccccctggccgcccctgcctccgaggacgccacccgtccgagacgccacgacgccggcccgtgggctcggccgtggtaccaacggccttaccgttccatcctaaccnctactggagcgggctgggacgaaggcgacgatagnnnnnnnnnnnnnnnnnnn

SEQ ID NO: 61907 - DNA, 436 bp, Homo sapiens
  misc_feature: GYAE6OF02I0CDU.37.62.F07.1.454.CMB.1.raw
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
  modified_base (427)..(436): a, c, t, g, unknown or other
  misc_feature (427)..(436): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagtgccgaggacacggccctatattattgtgcgaaatgtggggggagtgggggctactcctggcgttttgactactggggccaggggagccctggtcaccgtctcctcagcctccaccaagggcccatcggtcttccccctggccgccctgctccaggancacctccgagagcacagcggccctgggctgcctggtcaaggactactcatctacnctacngacgcgggctggcaaggcncatagnnnnnnnnnn

SEQ ID NO: 61908 - DNA, 681 bp, Homo sapiens
  misc_feature: GYAE6OF02INWMG.37.62.F07.1.454.CMB.1.raw
  modified_base (548)..(548): a, c, t, g, unknown or other
  misc_feature (548)..(548): n is a, c, g, or t
  modified_base (601)..(601): a, c, t, g, unknown or other
  misc_feature (601)..(601): n is a, c, g, or t
tcagtagtgtagatcacgaccggtgctcgattttagtagtcgcataaaagggaaaggggactggagtgggtcctcaggtaattggtggcagtggtgagaccacactactacgcagactcccgtgaagggccggttcaccatctccgagagaccaatttccaagaacaccctgtctctcgcaaatgaaccaacctcgagagccgaggacacggccctatattacgtggtacgaaaatggctacggatatgactactattgggactgtacttgatcgtctggggccgtggccaccctggtccactgtactctcacgtccctcacccgaacggggccccacgttccgggttaccctttaccccccggtgggtacccggaccccgtttggccgttacccggaagggaccgtacccgtaaccccgttaccggagtacggccaacccgaacggcccgggtacccgttacggggtccttcgacccgttgggttaaccaaacggtaccgttaccttccgaacttcctaacaccgtacgtacgacggtccgggtacngggtaacccgaaagggcccgtacgaacgttacgacgtcgactcgcgagtcacncgacgacgacgacgacgcgtctacgtcgtcgtcgctacgtacgtactcgtgtcgacgtccgtagtacggtacgtacgacg

SEQ ID NO: 61909 - DNA, 615 bp, Homo sapiens
  misc_feature: GYAE6OF02J3FBD.37.62.F07.1.454.CMB.1.raw
  modified_base (230)..(230): a, c, t, g, unknown or other
  misc_feature (230)..(230): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
  modified_base (576)..(576): a, c, t, g, unknown or other
  misc_feature (576)..(576): n is a, c, g, or t
  modified_base (578)..(579): a, c, t, g, unknown or other
  misc_feature (578)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (601)..(605): a, c, t, g, unknown or other
  misc_feature (601)..(605): n is a, c, g, or t
  modified_base (607)..(610): a, c, t, g, unknown or other
  misc_feature (607)..(610): n is a, c, g, or t
  modified_base (612)..(614): a, c, t, g, unknown or other
  misc_feature (612)..(614): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacattccaagaacaccctgtctctgacaaatgaacaacctgagagccgagacacgcctatatactgtaacgaaaatcggactacggatntagactatagttggactggtacttcgatcgtcgtcgggccgtcgcctaccgtggtccactcgtcctactcgacgtcctccgaccgaacggccacttccgtccttccccgcggcctcccgtcgcctaccgacgggactacccgaccgttaccggacgacgcccacggttccggccggtcccggttcgggaactcccggtcgtacgggtaccgtaaaaccggggtccttaaacccgtttccgaacctttaccgtaacccttaaccgtaccggtacggtaccgggtaccgggtaccgttacgggaccgaaacgggtccgtaaccgttagacgnacgnttcgcnctagcncnncncncncncncnncncngcncnnnnncnnnncnnnc

SEQ ID NO: 61910 - DNA, 598 bp, Homo sapiens
  misc_feature: GYAE6OF02GU9QT.37.62.F07.1.454.CMB.1.raw
  modified_base (426)..(426): a, c, t, g, unknown or other
  misc_feature (426)..(426): n is a, c, g, or t
  modified_base (448)..(448): a, c, t, g, unknown or other
  misc_feature (448)..(448): n is a, c, g, or t
tcagtagtgtagatcacgaccggtgctcgatttagtagtcgcataaagggggggtccctgagactctcctgtgcagcttcaggattcagctttagcagctacgccatgagctgggtccgccaggctccagggaagggactggagtgggtctcaggtattggtggcagtggtgagaccacatactacgcagactccgtgaagggccggttcaccatctccagagacaattccaagaacaccctgtctctgacaaatgaaacaacctgagagccgaggacacggccctatattactgtaacgaaaatggcctacggatatagactactattggactggtactcgatctctggggcctggctacccgtggtctacgtgtactcctcatccctaccaccgacgggcccctagtccggttccttcccccgnggtccgccctgcctccagggcncctacctccgacgtcgccacgacgcccgggcccgtggggtcctcggccgttagggtaccgaaacggtaccttaccgttccacgttcccgtaactaccgtacgtacgaacgggtccgggtacgttcggacgtaacgggcgtacctagtcgg

SEQ ID NO: 61911 - DNA, 747 bp, Homo sapiens
  misc_feature: GYAE6OF02J2ZA4.37.62.F07.1.454.CMB.1.raw
  modified_base (629)..(629): a, c, t, g, unknown or other
  misc_feature (629)..(629): n is a, c, g, or t
  modified_base (636)..(636): a, c, t, g, unknown or other
  misc_feature (636)..(636): n is a, c, g, or t
tcagtagtgtagatcacgaccggtgctcgatttagtagtcgcataaagggaaagggactggagtgggtctcaggtattggtggcagtggtgagaccacatactacgcagactccgtgaaggccggttcaccatctccagagacaattccaagacaccctgtctctgcaatgaacacctgacgagccgaggacacggccctatattacgtcgtacgaaactggcctacggatatgactactagttggactggtacttcgatcgtcgtcgggcccgtaggccacccgtggtcaccgttgtccgtccgttcgacggtccctcccgaaccgaacgggcccctaagttccggtccctttacccccgttgggtcccgccccccgtttggaccgttaccccggaccgggttacgcccgtaaccccgttcccggaaacgtccggaacccaaccggtacggtccccgggacccgttccgggggccttacgggtccccgttacggggttacccggaaacgggttacccctttaacccgtttcccgaacgttcccgtaaaccgtaaccgtttacccgtacggaacggttcccggggcgttaacgggaccttaacggggccgacccgttaaacggtccggngaacccncggaaccgtttgaccgtagtcgtacgcgtacgacgtacgtacgtacgtcgtacgtacgtactacgtactactacgtacgtacgtgtcgtcgtcgcgtacgtacgtacgacg

SEQ ID NO: 61912 - DNA, 464 bp, Homo sapiens
  misc_feature: GYAE6OF02IO4LE.37.62.F07.1.454.CMB.1.raw
  modified_base (406)..(406): a, c, t, g, unknown or other
  misc_feature (406)..(406): n is a, c, g, or t
  modified_base (428)..(430): a, c, t, g, unknown or other
  misc_feature (428)..(430): n is a, c, g, or t
  modified_base (432)..(433): a, c, t, g, unknown or other
  misc_feature (432)..(433): n is a, c, g, or t
  modified_base (435)..(436): a, c, t, g, unknown or other
  misc_feature (435)..(436): n is a, c, g, or t
  modified_base (440)..(441): a, c, t, g, unknown or other
  misc_feature (440)..(441): n is a, c, g, or t
  modified_base (443)..(444): a, c, t, g, unknown or other
  misc_feature (443)..(444): n is a, c, g, or t
  modified_base (446)..(464): a, c, t, g, unknown or other
  misc_feature (446)..(464): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtcttcccctggcgccctgcctcaggagcacctccgagacgcacagtggccctgggctgcctggtcaaggctacttccatctacactacngagcggctggcaggcgcatagnnncnnanngctnncnncnnnnnnnnnnnnnnnnnnn

SEQ ID NO: 61913 - DNA, 486 bp, Homo sapiens
  misc_feature: GYAE6OF02HIC8A.37.62.F07.1.454.CMB.1.raw
  modified_base (349)..(349): a, c, t, g, unknown or other
  misc_feature (349)..(349): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (441)..(442): a, c, t, g, unknown or other
  misc_feature (441)..(442): n is a, c, g, or t
  modified_base (444)..(444): a, c, t, g, unknown or other
  misc_feature (444)..(444): n is a, c, g, or t
  modified_base (446)..(448): a, c, t, g, unknown or other
  misc_feature (446)..(448): n is a, c, g, or t
  modified_base (450)..(479): a, c, t, g, unknown or other
  misc_feature (450)..(479): n is a, c, g, or t
  modified_base (481)..(486): a, c, t, g, unknown or other
  misc_feature (481)..(486): n is a, c, g, or t
tcagtagtgtagatcacgaccggtgctcgatttagtagtcgcataaagggaaaggggactggagtggggtctcaggtattggtggcagtggtgagaccacatactacgcagactccgtgaagggccggttcagtcatctcagagacaattccaagaacacctgtctctgcaaatgaacaactgagagaccgaagacacggccgtatattactgtgtgaaaggtctagggggagtggggggaactaacgtgggggaccaagggaaccctgggtcaccggtctcctcagcctccaccaagggccccatcggtacttccccctggccaccctcctccaaggcgccacctcgngggggtcacagccggccctgggctgcctggcaaggctactcatcgtacactactgagcggctggcgaagggcgactagtacgngtanangannanannncnnnnnnnnnnnnnnnnnnnnnnnnnnnnnncnnnnnn

SEQ ID NO: 61914 - DNA, 545 bp, Homo sapiens
  misc_feature: GYAE6OF02ILWWZ.37.62.F07.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (508)..(508): a, c, t, g, unknown or other
  misc_feature (508)..(508): n is a, c, g, or t
  modified_base (516)..(517): a, c, t, g, unknown or other
  misc_feature (516)..(517): n is a, c, g, or t
  modified_base (521)..(545): a, c, t, g, unknown or other
  misc_feature (521)..(545): n is a, c, g, or t
tcagtagtgtagatcacgaccggtgctcgatttagtagtcgcataaagggaaagggactggagtgggtctcaggtattggtggcagtggtgagaccacatactacgcagacctccgtgaagggccggttcaccatctccagagacaattccaagaacaccctgtcctctcgcaaatggaaccaacctcgaganccggagacgacggccctatatttacngtaacgaaatggacctagatatgactactatgggactggtactcgatctcgngggtccgtgcaccgtcggtcacgttgtctcctacncgccgtcccaccgacggcccgatccggtcccttcccctggcccctacccttcctacccaagtacgcctaccctcggtacggggccaacgacggccgtaccccgtgggcctccgaccttccgggactaaccggtactccccgtttaccgactcgtaacctacctaccgtggaacggccgggtactcggacgaacggccgtacngttaagcnnccgnnnnnnnnnnnnnnnnnnnnnnnnn

SEQ ID NO: 61915 - DNA, 471 bp, Homo sapiens
  misc_feature: GYAE6OF02FNSZS.37.62.F07.1.454.CMB.1.raw
  modified_base (454)..(455): a, c, t, g, unknown or other
  misc_feature (454)..(455): n is a, c, g, or t
  modified_base (457)..(471): a, c, t, g, unknown or other
  misc_feature (457)..(471): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgcctccagggacgccacctccgagacgccacagccgggcccctggggcctggccctgggtccaacggactacgttccatctacactactgaggcgggctgggcaacggcgcatagnngnnnnnnnnnnnnnnn

SEQ ID NO: 61916 - DNA, 573 bp, Homo sapiens
  misc_feature: GYAE6OF02IU7SE.37.62.F07.1.454.CMB.1.raw
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
  modified_base (536)..(537): a, c, t, g, unknown or other
  misc_feature (536)..(537): n is a, c, g, or t
  modified_base (542)..(542): a, c, t, g, unknown or other
  misc_feature (542)..(542): n is a, c, g, or t
  modified_base (547)..(552): a, c, t, g, unknown or other
  misc_feature (547)..(552): n is a, c, g, or t
  modified_base (556)..(557): a, c, t, g, unknown or other
  misc_feature (556)..(557): n is a, c, g, or t
  modified_base (559)..(561): a, c, t, g, unknown or other
  misc_feature (559)..(561): n is a, c, g, or t
  modified_base (563)..(563): a, c, t, g, unknown or other
  misc_feature (563)..(563): n is a, c, g, or t
  modified_base (566)..(567): a, c, t, g, unknown or other
  misc_feature (566)..(567): n is a, c, g, or t
  modified_base (571)..(572): a, c, t, g, unknown or other
  misc_feature (571)..(572): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggctacggatatgactactattgggactggtacttcgatctcgtggggccgtggccaccgtggtccactgtctcctcagccctccaccagggccagtccggtccttccccgtggccgccctgcctccagggtacgccaccgttcccgaggtagccaacgcggacccggtcccgtacggggccttcggcccgttacgggtaccaaaggggtacccttaacttcccgacttaccgttaacaccgttaacgtgggtaaccggcggggcccgtagggaccgaaacggtccggactagtaacggnacgtacgngctagcnngcgcngcgannnnnngcanncnnncngcnnctcnnc

SEQ ID NO: 61917 - DNA, 465 bp, Homo sapiens
  misc_feature: GYAE6OF02GB417.37.62.F07.1.454.CMB.1.raw
  modified_base (379)..(379): a, c, t, g, unknown or other
  misc_feature (379)..(379): n is a, c, g, or t
  modified_base (435)..(435): a, c, t, g, unknown or other
  misc_feature (435)..(435): n is a, c, g, or t
  modified_base (442)..(465): a, c, t, g, unknown or other
  misc_feature (442)..(465): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggactacggatatgactactattgggactggtactcgatctctggggccgtggcaccctggtcactgtctctcagcctccacaacgggcccatccggtccttccccgtggccgccctgcctccaggcgccacctccgagacgcacacggcggcccgngggctcgcctggtcaaggctcttcatcctactctactgagcgggctcgggcaggcncgatagnnnnnnnnnnnnnnnnnnnnnnnn

SEQ ID NO: 61918 - DNA, 444 bp, Homo sapiens
  misc_feature: GYAE6OF02F9RRA.37.62.F07.1.454.CMB.1.raw
  modified_base (324)..(324): a, c, t, g, unknown or other
  misc_feature (324)..(324): n is a, c, g, or t
  modified_base (427)..(444): a, c, t, g, unknown or other
  misc_feature (427)..(444): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacctggtcactgtctcctcagcctcaccaaggcccatcggcttccccnggcgccctgctccaggagcacctccgagagcacagcggccctgggctgcctggtcaaggctactcatctacactctgagcgggctcggcaagggctacatagnnnnnnnnnnnnnnnnnn

SEQ ID NO: 61919 - DNA, 570 bp, Homo sapiens
  misc_feature: GYAE6OF02HC82G.37.62.F07.1.454.CMB.1.raw
  modified_base (537)..(538): a, c, t, g, unknown or other
  misc_feature (537)..(538): n is a, c, g, or t
  modified_base (541)..(541): a, c, t, g, unknown or other
  misc_feature (541)..(541): n is a, c, g, or t
  modified_base (544)..(570): a, c, t, g, unknown or other
  misc_feature (544)..(570): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacgatatgactactagttggactggtacttcgatcgtcgtgggccgtggccacctggtcactgtctcctcacgcctccaccgacgggcccagtccggtccttcccccgtggcctccccgtgccttccgagggacgcccgacctccggagacgccacgacggccgggcccgtggggcctcgggcctcgggtacgaaacggtaccttacctttaccgacttccgtaccctaaccgtttaacctcgggtacgggccgggtcggttaccgggcccggtaaaccggggccgtaacggaacgttaacggcgtacgnncgngcnnnnnnnnnnnnnnnnnnnnnnnnnnn

SEQ ID NO: 61920 - DNA, 690 bp, Homo sapiens
  misc_feature: GYAE6OF02IL1IA.37.62.F07.1.454.CMB.1.raw
  modified_base (192)..(192): a, c, t, g, unknown or other
  misc_feature (192)..(192): n is a, c, g, or t
  modified_base (599)..(599): a, c, t, g, unknown or other
  misc_feature (599)..(599): n is a, c, g, or t
  modified_base (607)..(607): a, c, t, g, unknown or other
  misc_feature (607)..(607): n is a, c, g, or t
  modified_base (614)..(614): a, c, t, g, unknown or other
  misc_feature (614)..(614): n is a, c, g, or t
  modified_base (638)..(638): a, c, t, g, unknown or other
  misc_feature (638)..(638): n is a, c, g, or t
tcagtagtgtagatcacgaccggtgctcgatttagtagtcgcataaaagggaaagggtacgtggagtgggtctcaggtattggtggcagtggtgagaccacatactacacagacgtccgtgaagggccgttcaccatctccagagacaattccaagaacaccctgtctctgacaaactgaacaacctgacgngccgagacacggcctatattactgtaacgaaaatgacctacgatatgactactataggactggtactgatctcgtgggcctaggctacccgtggtacacttcgtctacctacacgtcccttaccgaacccgaacgggtcccctaagtccggttaccctttcccccgtggcccgtccccgttggaccctcccggtaagggacgtccctaaccgtccggaagacggacctaacgtaccgggccggtccccgtagggtcctcggacccgttagggttaaccgaaacggttaacctttaacccgtttacccgtaactttacccgtaaaccctacgttaaaccgtcgggaacggtccgggtaaccgttaggaaccggtaaacgggtcccgaataaccgtaagtacaacgtanacgttcgngacgtanacaagtacactaagacacgtacgntacactacgacgtactactacgtactacgtactactcgtacgtactcagtac

SEQ ID NO: 61921 - DNA, 518 bp, Homo sapiens
  misc_feature: GYAE6OF02JC6M6.37.62.F07.1.454.CMB.1.raw
  modified_base (489)..(518): a, c, t, g, unknown or other
  misc_feature (489)..(518): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcacgcctccaccgaacgggccccagtccggtcttcccccgtggccgccctgcctcccgaggacgccaccgtccgagacgcacgagccgggcccgtggggctcggccgttcggtacgaaacggtaccttacctttcccacttacctaaccacttacgtggacggccggggtctgggccaacgggccgacataggcnnnnnnnnnnnnnnnnnnnnnnnnnnnnnn

SEQ ID NO: 61922 - DNA, 522 bp, Homo sapiens
  misc_feature: GYAE6OF02JTVEB.37.62.F07.1.454.CMB.1.raw
  modified_base (211)..(211): a, c, t, g, unknown or other
  misc_feature (211)..(211): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
  modified_base (494)..(522): a, c, t, g, unknown or other
  misc_feature (494)..(522): n is a, c, g, or t
tcagtagtgtagatcacgaccggtgctcgatttagtagtcgcataaagggaaagggaacgtggagtgggtctcaggtattggtggcagtggtgagaccacatactacgcagactccgtgaaggccggttcaccatctccagagacaattccaagaacaccctgtctctgcaaatgaacaacctgagagccgaggacacggccctatatacngtacgaaaatggcctacggatatgactactattgggaccttggtacttcgatctctggggccgtggcaccccgttggtctactgtctccgtcagcctccacaacgggcccatcggtcctcccctggccaccctcgcctcgagtcncgacctccganacgctacacggccggcccctggggcctgacccgtggtaccaacgggtctaccgttccgacttccgaacgtacttaccgtgaacgtcgggctcggacgtaggaccgtnaacgttaggctagngttccnnnnnnnnnnnnnnnnnnnnnnnnnnnnn

SEQ ID NO: 61923 - DNA, 817 bp, Homo sapiens
  misc_feature: GYAE6OF02HOODS.37.62.F07.1.454.CMB.1.raw
  modified_base (142)..(142): a, c, t, g, unknown or other
  misc_feature (142)..(142): n is a, c, g, or t
  modified_base (751)..(751): a, c, t, g, unknown or other
  misc_feature (751)..(751): n is a, c, g, or t
tcagtagtgtagatcacgaccggtgctcgatttagtagtcgcataaagggtaaagggtacggtggagtgggtactcgaggtagttggtgggcagtggtagagaccgacatactaacgccagacttccgtgtaaggccggttnaccatctccgagagacaagttccaagaacgaccctgtctctgcaaactgaacaacctgagacgcgaggacacggccctatagttactgtaacgaaaactcggacctacggatatgactactattgggactggttacttcgatctcgtcgggacctggaccaacccgttggtaccacgttggtccttccgtcacggtaccctccgaaacccgtaacgggcccctaacgttccgggtacccttttccccccggtggtcccgtaccccgtttcggtcccgttacccgaacgggtaaccggtacccggtaaccccggttacccgggaaccggtaccggacccgtaaaccgtaacgggtcccggggtacccccggttggggggtacccggttcgggtaccccggttacgggggttaacccgtaaaacgggggttaacccttttaacccggtttacccccgtaagttttacccccgttaaaaccaaccccgttttaaccggttacgggaaacccgggtccggggttacccgttaccggggaaccggaaacggggtccggtaaccgttaaggttaacgttcggatcgtttacgcgttcgatccgattaccattatntgcgtcgtcgtacgtgtcgtcgacgtacgtacgtacgtagacgacgacgtacgtacgtacgtgtcg

SEQ ID NO: 61924 - DNA, 526 bp, Homo sapiens
  misc_feature: GYAE6OF02GXYP4.37.62.F07.1.454.CMB.1.raw
  modified_base (210)..(210): a, c, t, g, unknown or other
  misc_feature (210)..(210): n is a, c, g, or t
  modified_base (349)..(349): a, c, t, g, unknown or other
  misc_feature (349)..(349): n is a, c, g, or t
  modified_base (489)..(490): a, c, t, g, unknown or other
  misc_feature (489)..(490): n is a, c, g, or t
  modified_base (494)..(497): a, c, t, g, unknown or other
  misc_feature (494)..(497): n is a, c, g, or t
  modified_base (499)..(502): a, c, t, g, unknown or other
  misc_feature (499)..(502): n is a, c, g, or t
  modified_base (504)..(526): a, c, t, g, unknown or other
  misc_feature (504)..(526): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattacngtacgaaaatggcctacggatatgactactattgggactggtacttcgatcttcgtggggccgttggcacccgtggtctacgtgtctcctcacgtcctaccacgaacgggccccagtccggttccttcccccgtggccncccctgccgtccgaggcgcaccgtcgacgagccacaggccggtacccgtgggacctcggcccttgggtaccaaagggtcctactccatacctacactactggacggtcgggtcgtcggcgtaaagggcctcgaagtacgnnacgnnnngnnnngnnnnnnnnnnnnnnnnnnnnnnn

SEQ ID NO: 61925 - DNA, 445 bp, Homo sapiens
  misc_feature: GYAE6OF02JDY1F.37.62.F07.1.454.CMB.1.raw
  modified_base (428)..(445): a, c, t, g, unknown or other
  misc_feature (428)..(445): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctgcgccctgctccaggagcacctccgagcgcacagcggccctgggctgcctggtcaaggactacttccatctacactactgagcggctggcaggcgcatagnnnnnnnnnnnnnnnnnn

SEQ ID NO: 61926 - DNA, 501 bp, Homo sapiens
  misc_feature: GYAE6OF02IU2W9.37.62.F07.1.454.CMB.1.raw
  modified_base (166)..(166): a, c, t, g, unknown or other
  misc_feature (166)..(166): n is a, c, g, or t
  modified_base (336)..(336): a, c, t, g, unknown or other
  misc_feature (336)..(336): n is a, c, g, or t
  modified_base (469)..(469): a, c, t, g, unknown or other
  misc_feature (469)..(469): n is a, c, g, or t
  modified_base (475)..(476): a, c, t, g, unknown or other
  misc_feature (475)..(476): n is a, c, g, or t
  modified_base (478)..(484): a, c, t, g, unknown or other
  misc_feature (478)..(484): n is a, c, g, or t
  modified_base (486)..(501): a, c, t, g, unknown or other
  misc_feature (486)..(501): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacacccttgtctntgcaaatgaacaacctgagagccgaggacacggccctatattactgtacgaaaatggcctaaggatatgactactagttgggactggtacttcgatctcgtgggccgtggccaccgtggtcactcgtctcctcacgcctccacccgaaggcccagtccggtccttccccnggcctaccccttcctaccgaacgcgacctaccgtccggtagggggaccacgacggcccgtcggcgtcgtcgcgtacggaaccgtacgtaccttactacgtactactacctatacgtggcggcgtgcgacgcgnatagcnngnnnnnnncnnnnnnnnnnnnnnnn

SEQ ID NO: 61927 - DNA, 572 bp, Homo sapiens
  misc_feature: GYAE6OF02F9F4P.37.62.F07.1.454.CMB.1.raw
  modified_base (128)..(128): a, c, t, g, unknown or other
  misc_feature (128)..(128): n is a, c, g, or t
  modified_base (464)..(464): a, c, t, g, unknown or other
  misc_feature (464)..(464): n is a, c, g, or t
  modified_base (467)..(468): a, c, t, g, unknown or other
  misc_feature (467)..(468): n is a, c, g, or t
  modified_base (484)..(484): a, c, t, g, unknown or other
  misc_feature (484)..(484): n is a, c, g, or t
  modified_base (504)..(504): a, c, t, g, unknown or other
  misc_feature (504)..(504): n is a, c, g, or t
  modified_base (518)..(518): a, c, t, g, unknown or other
  misc_feature (518)..(518): n is a, c, g, or t
tcagtagtgtagatcacgaccggtgctcgatttagtagtcgcataaagggaaagggactggagtgggtctcaggtattggtggcagtggtgagaccacatactacgcagactccgtgaaggccggttnaccatctccagagacaattccaagaacacgctctatctgcaaatgaacagcctgagagccgaagacacggccgtatattactgtgtgaaaggcgtggggatgggggactacgtcggggccagggaaccctggtcaccgtctccgtcacgcctccaccgaaggcccatccggtcctttccccctggcctacccgtctacccgaagacgccaacccgtcgtgggggtccaccaggccggacccgtgggccttggccgttggtacaacgggtctacgttccgacttacacctactacgtggacgtccgggcgttcggactacggcgtactactacgtcncgnnctcgagtcagattcgnactgactagcagctacgacngtctcaagctaggnctgacgtacgtacgtacgtacgacgtcgtacgtacgcgacgtacgacgctatcg

SEQ ID NO: 61928 - DNA, 557 bp, Homo sapiens
  misc_feature: GYAE6OF02JRPV0.37.62.F07.1.454.CMB.1.raw
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (534)..(537): a, c, t, g, unknown or other
  misc_feature (534)..(537): n is a, c, g, or t
  modified_base (539)..(539): a, c, t, g, unknown or other
  misc_feature (539)..(539): n is a, c, g, or t
  modified_base (541)..(557): a, c, t, g, unknown or other
  misc_feature (541)..(557): n is a, c, g, or t
tcagtagtgtagatcacgaccggtgctcgatttagtagtcgcataaaagggaaagggactggagtggggtctcaggtattggtggcagtggtgagaccacatactacgcagactccgtgaagggccggttcaccatctccagagacaattccaagaacaccctgtctatgcaaatgaacaacctgagagccgaggacacggccctatattactgtaacgaaaatggcctacggatatgactactagttggactggtacttcgatctcgtggggccgtggccaccctggtcactggtcctcctcacgccctaccaccgaacgggccctacgtccggtcccttccccgtgggcccgtcccncgtcctcccggaggacnccgaccctccgacgacgcacgacggtcccggccgtcgggccgtcgcccgttggggtacccaaaggtaccctttacttccgacctacctaacacccgttacgtagggaccggtcgggcgttacgggaccgaagggccgaccgtactaggctancancgnnnngncnnnnnnnnnnnnnnnnn

SEQ ID NO: 61929 - DNA, 463 bp, Homo sapiens
  misc_feature: GYAE6OF02HRWT8.37.62.F07.1.454.CMB.1.raw
  modified_base (356)..(356): a, c, t, g, unknown or other
  misc_feature (356)..(356): n is a, c, g, or t
  modified_base (433)..(434): a, c, t, g, unknown or other
  misc_feature (433)..(434): n is a, c, g, or t
  modified_base (436)..(463): a, c, t, g, unknown or other
  misc_feature (436)..(463): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaaacctgagagccgaggacacggcctatattactgtacgaaaatggcctacggatatgactactattgggactggtacttcgatctctgggccgtggcaccctggtcactgtctcctcagcctccaccaaagggcccatcggtcttcccctggcgccctgctccaggagcacctccgagngcacagcggccctgggctgcctggtcaaggctacgttccaatctacactactgagcgggctggcaaaggcgcatagnngnnnnnnnnnnnnnnnnnnnnnnnnnnnn

SEQ ID NO: 61930 - DNA, 551 bp, Homo sapiens
  misc_feature: GYAE6OF02JCRRX.37.62.F07.1.454.CMB.1.raw
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
  modified_base (510)..(511): a, c, t, g, unknown or other
  misc_feature (510)..(511): n is a, c, g, or t
  modified_base (513)..(513): a, c, t, g, unknown or other
  misc_feature (513)..(513): n is a, c, g, or t
  modified_base (519)..(521): a, c, t, g, unknown or other
  misc_feature (519)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
  modified_base (549)..(551): a, c, t, g, unknown or other
  misc_feature (549)..(551): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattacctgtacgaaaactggcctacggatatgactactattgggactggtacttcgatctcgtgggccgtggcacccgtggtcactgtctcctcagcctccaccgaacggcccatccggtccttcccctggccgccctgcctccaggacgccacctccgagacgtcaacacggccggccctaggggctcggcccgttgggtaccaaacgggtaccttaaccttccgacttaccgtaaccaacttaccgtaggacggtccgggcgtacgggacaacgggccgacgaacgttacggcagcgnctngcnncncgcgcnnncncngagcgcnncncncnncncncnncnnn

SEQ ID NO: 61931 - DNA, 482 bp, Homo sapiens
  misc_feature: GYAE6OF02FSFP1.37.62.F07.1.454.CMB.1.raw
  modified_base (459)..(459): a, c, t, g, unknown or other
  misc_feature (459)..(459): n is a, c, g, or t
  modified_base (467)..(482): a, c, t, g, unknown or other
  misc_feature (467)..(482): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacccctggtcactgtctcctcagcctccaccaacgggcccaatccggtaccttccccctgggccgcccctgcctccaggacgccacctccgagagcacacggcggccctggggctcgcctggtcaaaggattaaccttccagttcctacactactacggagcgggactgggaccaagggccgnaagttagnnnnnnnnnnnnnnnn

SEQ ID NO: 61932 - DNA, 533 bp, Homo sapiens
  misc_feature: GYAE6OF02JOQD3.37.62.F07.1.454.CMB.1.raw
  modified_base (330)..(330): a, c, t, g, unknown or other
  misc_feature (330)..(330): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
  modified_base (501)..(533): a, c, t, g, unknown or other
  misc_feature (501)..(533): n is a, c, g, or t
tcagtagtgtagatcacgaccggtgctcgatttagtagtcgcataaagggaaagggactggagtgggtctcaggtattggtggcagtggtgagaccacatactacgcagactccgtgaaggccgcttcaccatctccagagactattccaagagcactctgtatctgcaaatgaacagcctgagtgccgaggacacggccctatattattgtgcgaaatggtgggggagtgggggctacgtccgtggtcgttttgactacgtgggccagggagcctggtcaccgtctcctcagcctccaccgaacgggcccagtccggtccttcccccgnggccgccccgtcgcctcccgagggacgcctacccgtccggacgacgcctaccgacgccggccctcgggcttcgcccgtcggtcaaacgggtaccttccgttacccattcccgtaacaccttacgtcggaacggtcgggtcctacgggcgtaacggccgtnactaggtcngnnnnnnnnnnnnnnnnnnnnnnnnnnnnnnnnn

SEQ ID NO: 61933 - DNA, 661 bp, Homo sapiens
  misc_feature: GYAE6OF02JF0BB.37.62.F07.1.454.CMB.1.raw
  modified_base (558)..(558): a, c, t, g, unknown or other
  misc_feature (558)..(558): n is a, c, g, or t
  modified_base (589)..(589): a, c, t, g, unknown or other
  misc_feature (589)..(589): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgacaaatgaacaacctgagagccgaggacacggccctatattactgtaacgaaaatggcctacggatatgactactagttgggactggtacttcgatctctggggccgtggcacctggtcactgtctcctcacgcctccaccgaacgggccccagtccggttccttccccccgtggcccgtcccgtgcccgttccgacggacgcgacccgtcccggagacgccaacgacggccggtaccccgtggggtcctcggcccgttagggtaccgaaacgggtaaccttaccgtttcccgaacttacccgttaactaccttaaccggttagaccgggccggggtccgttcggggtaacccgtaaacggggcccggtaacgaacgtttaacggacgtnaacgtcgcgtagacacgtcgacgcgacgtcncgtacgacgtccgtacgacgtacgactatccgtcgtacgtactacgtacgtacgtaggtacgtacgtacgtc

SEQ ID NO: 61934 - DNA, 803 bp, Homo sapiens
  misc_feature: GYAE6OF02G7OUV.37.62.F07.1.454.CMB.1.raw
  modified_base (184)..(184): a, c, t, g, unknown or other
  misc_feature (184)..(184): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctganagccgaggacacggccctatacttactgtacgaaaatcggcctacggatatgactactattggactggtacttcgatctctgggcgttggcaccctggtcactgtctacctcgagcctccaccgaacgggccctaactcgggtcttcccccgtacggtccgtccctgccgttccgacggacggtcgaccctccggtacgaacgtccgaaccacggccgggacccctcggggtccttacggacccgttcgggtcctaaaacgggggacctttaaccggtttcccgaaccttttacccgttaaaccgtaacccgtttaacccttacggggttaacggtacccgggggggtcctttaaccgggggacccgttaaaacgggggacccgtaccggtaacccgttttaaaggccgttaacgccctttaagggtcctaagccggtttaaacggtacgtttccgtaacccgttttggggtaaaccccttactaaacggggtttttacccgggtacgtttttaaaccccgtacgggggttttaaaacccccgtacggttaccgtacggtaaccggttacggtaccgtaccggtaccggttaccgtacggtaccggttacggtacgtcg

SEQ ID NO: 61935 - DNA, 535 bp, Homo sapiens
  misc_feature: GYAE6OF02IN95T.37.62.F07.1.454.CMB.1.raw
  modified_base (97)..(97): a, c, t, g, unknown or other
  misc_feature (97)..(97): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (385)..(385): a, c, t, g, unknown or other
  misc_feature (385)..(385): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
  modified_base (499)..(500): a, c, t, g, unknown or other
  misc_feature (499)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (530)..(531): a, c, t, g, unknown or other
  misc_feature (530)..(531): n is a, c, g, or t
  modified_base (534)..(535): a, c, t, g, unknown or other
  misc_feature (534)..(535): n is a, c, g, or t
tcagtagtgtagatcacgaccggtgctcgatttagtagtcgcataaagggaagggactggagtgggtctcaggtattggtggcagtggtgagaccanatactacgcagactccgtgaagggccgttcaccatcctccagagacaattccaagaaccaccctgtctctgacaaatgaacaacctgagacgcgagacaccggccctatactactgtaacgaaatgcctacggatatgaactactagttgggactcggtactcgatcgtcgtgggccgtgcaccgtgtcactgtctcctcngcctccaacgacggcccagtccggtccttccccgngtccgacctgcctccgagacgcctaccgtcgagacgcacgacgcggtcccgnggcctacgcctcggacgaacggtacctacctccgtactcctaacactcgtacgacgtcggaccgtggaaccgacggcgaccgaagttcgancgtacngcgatcagnacgcagcnncnananacgngngngcgacncgngnanctnncgnn

SEQ ID NO: 61936 - DNA, 581 bp, Homo sapiens
  misc_feature: GYAE6OF02FQ5Z1.37.62.F07.1.454.CMB.1.raw
  modified_base (356)..(356): a, c, t, g, unknown or other
  misc_feature (356)..(356): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccaggagacaattccaagaacaccctgtctctgcaaatgaacaacctgagagccgaggacacggccctatattactgtacgaaaatggcctacggatatgactactattgggactggtacttcgatctcgtggggccgtggcaccctggtccactgtctcctcacgcctccaccaagggcccatcgggtccttccccctggccgtccctgcctccgaggngccacccgtccgacgacgcacgacgcggcccgtgggcctgccgtcggtacaacggtacctaccgttaccacttactacaccttacgtacgaggtccggggactcgggactaacgggcgtacgtaacgtacgntacgntcgntagcgactgcgtacncgaccgtanacgngtacgtacgtgacgcgacgtactcgtcgtcgtacncgtaccgntacgtcctagtcg

SEQ ID NO: 61937 - DNA, 536 bp, Homo sapiens
  misc_feature: GYAE6OF02JHTYQ.37.62.F07.1.454.CMB.1.raw
  modified_base (210)..(210): a, c, t, g, unknown or other
  misc_feature (210)..(210): n is a, c, g, or t
  modified_base (496)..(497): a, c, t, g, unknown or other
  misc_feature (496)..(497): n is a, c, g, or t
  modified_base (500)..(501): a, c, t, g, unknown or other
  misc_feature (500)..(501): n is a, c, g, or t
  modified_base (507)..(507): a, c, t, g, unknown or other
  misc_feature (507)..(507): n is a, c, g, or t
  modified_base (509)..(510): a, c, t, g, unknown or other
  misc_feature (509)..(510): n is a, c, g, or t
  modified_base (512)..(516): a, c, t, g, unknown or other
  misc_feature (512)..(516): n is a, c, g, or t
  modified_base (518)..(536): a, c, t, g, unknown or other
  misc_feature (518)..(536): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattacngtacgaaaatggcctacggatatgactactattgggactggtacttcgatctctggggccgtggcaccctggtcactgtctcctcagcctccaccaacgggccccagtccggtcctttccccctgggccgtcccctgcctcccgagggacgcctacctccgacggtagccacgacgccgggtccgtcggggctacggccgttcggtacgaacgggtacctaccgtttccactctaaccactacgtaggacggcgggtccgtgggacgaaacggccgtacagtacgnngannactgcngnngnnnnngnnnnnnnnnnnnnnnnnnn

SEQ ID NO: 61938 - DNA, 510 bp, Homo sapiens
  misc_feature: GYAE6OF02G6PBF.37.62.F07.1.454.CMB.1.raw
  modified_base (235)..(235): a, c, t, g, unknown or other
  misc_feature (235)..(235): n is a, c, g, or t
  modified_base (476)..(476): a, c, t, g, unknown or other
  misc_feature (476)..(476): n is a, c, g, or t
  modified_base (478)..(480): a, c, t, g, unknown or other
  misc_feature (478)..(480): n is a, c, g, or t
  modified_base (482)..(510): a, c, t, g, unknown or other
  misc_feature (482)..(510): n is a, c, g, or t
tcagtagtgtagatcacgaccggtgctcgatttagtagtcgcataaaaggggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtgcgagagatcagacggatanagcagcagctctgactacgtggggccacggaaccctggtcaccgtctcctcacgcctcccaccgaacgggccccagtccggttcccttccccccgtcggccctacccctccctaccaacgacgccaccctcggtcgggggcacgacgccggcccgtgggcctcgccgtggtacaacggtactaccttccactctaccactacgtggacggccgggcgtcggacgaacgggcgacgtatagncnnncnnnnnnnnnnnnnnnnnnnnnnnnnnnnn

SEQ ID NO: 61939 - DNA, 683 bp, Homo sapiens
  misc_feature: GYAE6OF02IGSFF.37.62.F07.1.454.CMB.1.raw
  modified_base (536)..(536): a, c, t, g, unknown or other
  misc_feature (536)..(536): n is a, c, g, or t
tcagtagtgtagatcacgaccggtgctcgatttagtagtcgcataaagggggggtccctgagactctcctgtgcagcttcaggattcagctttagcagctacgccatgagctgggtccgccaggctccagggaagggactggagtgggtctcaggtattggtggctagtggtgagaccacatactacgcagactccgtgaagggccggttcaccatcctccagagtacaattccaaagaacaccctgtctctgacaaatgaaacaacctgaagcgaccgaggaccgaccggcccttaatactttactagaacgtaaaaatcggtaccttaacggactatacgactactagttacgggacgtggttaaccttcgtaactccgtcgttacggggtccggtcggacctaccgtggttacaccgttcggtaccctccttacgcgtaccctaccaaccgtaacgggccccttacgtacccggttccccttcccccgttcgggacccgtccccgtacgcctaacccgtagggaccgtacccncccggtacccgaagtaccgacgaacgtcccggaccggtcccgtcgggaccttcggccgttcgggtaccaaacgggttacctacttaccacgtttcaacgtactacgtacgaccgggcggtacgtccggaccgaaggacctacatacg

SEQ ID NO: 61940 - DNA, 557 bp, Homo sapiens
  misc_feature: GYAE6OF02FFGYE.37.62.F07.1.454.CMB.1.raw
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (451)..(451): a, c, t, g, unknown or other
  misc_feature (451)..(451): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (507)..(509): a, c, t, g, unknown or other
  misc_feature (507)..(509): n is a, c, g, or t
  modified_base (515)..(515): a, c, t, g, unknown or other
  misc_feature (515)..(515): n is a, c, g, or t
  modified_base (518)..(519): a, c, t, g, unknown or other
  misc_feature (518)..(519): n is a, c, g, or t
  modified_base (522)..(524): a, c, t, g, unknown or other
  misc_feature (522)..(524): n is a, c, g, or t
  modified_base (529)..(530): a, c, t, g, unknown or other
  misc_feature (529)..(530): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
tcagtagtgtagatcacgaccggtgctcgatttagtagtcgcataaagggaagggactggagtgggtctcaggtattggtggcagtggtgagaccacatactacgcagactccgtgaaggccggttcaccatctccagagacaattccaagaacaccctgctctgacaaatgaaccaacctgagagtccgaggaccacgacctatatactgtaacgaaatggacctacggatangtactatacgtggacttggtacttcgatactcggtacgggcctacgactccccgtggctactgtcctccgtacncgtccctaccgacgacggcctacgttccggtaccctccccgnggaccgtcccgtcgtctaccgnggaacctccaccgtcgagcgccacgtacggcccggtacgcggactgaccgtagacgaacgtctactccgattcacgtanacgtggtacgacggtcaggaccgaagtccaagttacganccgtagngacngcagtnnntagacntanncannnacgannacgactcgtananacgacncncacntc

SEQ ID NO: 61941 - DNA, 723 bp, Homo sapiens
  misc_feature: GYAE6OF02IWBP1.37.62.F07.1.454.CMB.1.raw
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (656)..(656): a, c, t, g, unknown or other
  misc_feature (656)..(656): n is a, c, g, or t
  modified_base (661)..(661): a, c, t, g, unknown or other
  misc_feature (661)..(661): n is a, c, g, or t
  modified_base (665)..(665): a, c, t, g, unknown or other
  misc_feature (665)..(665): n is a, c, g, or t
  modified_base (690)..(690): a, c, t, g, unknown or other
  misc_feature (690)..(690): n is a, c, g, or t
  modified_base (707)..(707): a, c, t, g, unknown or other
  misc_feature (707)..(707): n is a, c, g, or t
tcagtagtgtagatcacgaccggtgctcgatttagtagtcgcataaagggaagggactggagtgggtctcaggtattggtggcagtggtgacgaccacatactacgcagactccgtgaagggccggttcaccatctccagagacattccaagaacaccctgtctctgcaaatgaacacctgagagccgaggacacggcctagtactactgaacgaaatcggaccgtacggatagtagactatattgggacttggtacttcgattctcgngggaccgtggaccaccctggtaccnctcgttctcctaccacggcccttacccaaccgtaaccggggtcccctaacgttccgggttccccgtttacccccctacggggtccccgtacccgttaccgacccgttcccgtaaggtaccgtaccgtaaccctaccggtaacgtacgtacccgtaaacggtaccgggtaccggtaccccggttcggggacccttacgggtacccgttacgggttaccgtaaaaccggtccgttttaaacccgtccgttacgtaaccctaacccgtaacgttaacgttcggtaaaccggtcggggtaacgtcgggttaaccggaaacggtcccgggaaccttaacgttagggacaactccgagacgtaaccgngtacngacnactgactcgacactcgcgtacgacncgcgtccgacgtctacncacgtgacacgacgcg

SEQ ID NO: 61942 - DNA, 503 bp, Homo sapiens
  misc_feature: GYAE6OF02JFZO0.37.62.F07.1.454.CMB.1.raw
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (410)..(411): a, c, t, g, unknown or other
  misc_feature (410)..(411): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (468)..(470): a, c, t, g, unknown or other
  misc_feature (468)..(470): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (501)..(501): a, c, t, g, unknown or other
  misc_feature (501)..(501): n is a, c, g, or t
tcagtagtgtagatcacgaccggtgctcgatttagtagtcgcataaagggaaggggactggagtgggtctcaggtattggtggcagtggtgagaccacatactacgcagactcgtgaagggccggttcaccatctccagagacaattccaagaacaccctgtctctgcaaatgaacaacctgagagccgaggacacggccctatattactgtacgaaaatggacctacggatatgactacattgggactcggtacttcggatctacgtggggaccgtggcgacccttggtcacctaggtcctaccgttacaagtcccagacacngananancananagcncagtacgacactacgactcactacganacacgacgagatacgacgagacangacactagtacgagcagannacgagananagagacgacacganagtanaganacacagagacgananacagananannnctnatacgnacgagtagacagacgtatacanag

SEQ ID NO: 61943 - DNA, 788 bp, Homo sapiens
  misc_feature: GYAE6OF02HIHBR.37.62.F07.1.454.CMB.1.raw
  modified_base (211)..(211): a, c, t, g, unknown or other
  misc_feature (211)..(211): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattacngtacgaaaatggcctacggatatgactactagttggactggtacttcgatctcgtgggccgtggcaccctggtcacgtcgtactcctcacgccctccaacccgacggggaccccagtttaccggtccctttcccccccgtagggccccgtccccgttacggtcccgtaccccgtaacggggacgtacccgtaaccccgttcccggaaacggacgacccgaaaccgtaacccggggtcccggggtaaccccccggttcgggggacccctttacggggtacccccgtttacgggggttaacccgaaaaccgggggttaaccccttttaaccccggtttaaccccgtaaccgtttaccccttaaaacccgttaacccttttaaaccccgggttaaggaaaccgggggttcccgggggtaccgggtttaccgggaacccgggaaaccggggtaacccggttaccgtaaaccggttaacggttcaagtcggactccgttacacgtaacgcgtacgtacgtacgtcgtacgtcgacgacgtcgacgcgcgacgacgacgtacgagacgcacgagacgcgtgcg

SEQ ID NO: 61944 - DNA, 613 bp, Homo sapiens
  misc_feature: GYAE6OF02HA59K.37.62.F07.1.454.CMB.1.raw
  modified_base (164)..(164): a, c, t, g, unknown or other
  misc_feature (164)..(164): n is a, c, g, or t
  modified_base (293)..(293): a, c, t, g, unknown or other
  misc_feature (293)..(293): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (582)..(583): a, c, t, g, unknown or other
  misc_feature (582)..(583): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
  modified_base (592)..(593): a, c, t, g, unknown or other
  misc_feature (592)..(593): n is a, c, g, or t
  modified_base (596)..(596): a, c, t, g, unknown or other
  misc_feature (596)..(596): n is a, c, g, or t
  modified_base (600)..(601): a, c, t, g, unknown or other
  misc_feature (600)..(601): n is a, c, g, or t
  modified_base (605)..(605): a, c, t, g, unknown or other
  misc_feature (605)..(605): n is a, c, g, or t
  modified_base (608)..(608): a, c, t, g, unknown or other
  misc_feature (608)..(608): n is a, c, g, or t
  modified_base (611)..(611): a, c, t, g, unknown or other
  misc_feature (611)..(611): n is a, c, g, or t
tcagtagtgtagatcacgaccggtgctcgatttagtagtcgcataaagggaagggactggagtgggtctcaggtattggtggcagtggtgagaccacatactacgcagactccgtgaagggccggttcaccatctccagagacaattccaagaacaccctgtcnctgcaaatgaacaacctgagagccgaggacacggccctatattactgtaacgaaaatggcctacggatatgactactattgggactggtactcgatctcgtgggccgtgcacctggtcactgtctcctnacgcctccaccgaacgggccccagtaccggtcctttaccccccgtcgggtcccgtcccctcgtccttacccgagggtacgccctaccccgtccgaacgacgtacccaacgacggccggcccgtcggggccgttcggcccgttgggtacaaacggggacctttaaccgtttcccgaacttccctaactaacccgttaacgttcggaacggccggggtaccgttacggggaccggtaaacgggccggaactaacggtacggtanacgcncgtangtcagcgncgancgacnnacananncnncgngacnnctcntgntcngc

SEQ ID NO: 61945 - DNA, 440 bp, Homo sapiens
  misc_feature: GYAE6OF02HWRBH.37.62.F07.1.454.CMB.1.raw
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (423)..(424): a, c, t, g, unknown or other
  misc_feature (423)..(424): n is a, c, g, or t
  modified_base (427)..(440): a, c, t, g, unknown or other
  misc_feature (427)..(440): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacccgtggtcactgtctcctcagcctccaccaagggcccatcggtcttccccctggcnccctgctccaggcgcacctcgagncacagcgccctggctgcctgtcagctctcntctacnctactgagcgggctggcaaggcgcatagnntgnnnnnnnnnnnnnn

SEQ ID NO: 61946 - DNA, 557 bp, Homo sapiens
  misc_feature: GYAE6OF02HZUA9.37.62.F07.1.454.CMB.1.raw
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (531)..(531): a, c, t, g, unknown or other
  misc_feature (531)..(531): n is a, c, g, or t
  modified_base (536)..(542): a, c, t, g, unknown or other
  misc_feature (536)..(542): n is a, c, g, or t
  modified_base (544)..(557): a, c, t, g, unknown or other
  misc_feature (544)..(557): n is a, c, g, or t
tcagtagtgtagatcacgaccggtgctcgatttagtagtcgcataaaagggaagggactggagtgggtctcaggtattggtggcagtggtgagaccacatactacgcagactccgtgaagggcggttcaccatctcagagacaattccaagaacaccctgtctctgcaaatgaacaacctgagagccgaggacacggcctatattactgtaacgaaaatggcctaggattatgactactattgggactggtactgatctcgtgggccgtggccaccgtgtcactgtctctcacgccctcaccgaaggcccagtccggtccttccccnggccncccgtgccctcgaggcgcctaccgtccgagacacgacgacggcccgggacccgttcggggcctcgtcccgttagggaccgaaagggtccctttaccgttccaacgtttaccctaaccgtaaccttacggtacggaccgggcggggtctcgggaaccgtaacgggccgtacgtaagtcggacatgacagcagctgctagntacgnnnnnnngnnnnnnnnnnnnnn

SEQ ID NO: 61947 - DNA, 559 bp, Homo sapiens
  misc_feature: GYAE6OF02H5GBI.37.62.F07.1.454.CMB.1.raw
  modified_base (154)..(154): a, c, t, g, unknown or other
  misc_feature (154)..(154): n is a, c, g, or t
  modified_base (184)..(184): a, c, t, g, unknown or other
  misc_feature (184)..(184): n is a, c, g, or t
  modified_base (231)..(231): a, c, t, g, unknown or other
  misc_feature (231)..(231): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (526)..(527): a, c, t, g, unknown or other
  misc_feature (526)..(527): n is a, c, g, or t
  modified_base (530)..(531): a, c, t, g, unknown or other
  misc_feature (530)..(531): n is a, c, g, or t
  modified_base (533)..(546): a, c, t, g, unknown or other
  misc_feature (533)..(546): n is a, c, g, or t
  modified_base (548)..(550): a, c, t, g, unknown or other
  misc_feature (548)..(550): n is a, c, g, or t
  modified_base (553)..(555): a, c, t, g, unknown or other
  misc_feature (553)..(555): n is a, c, g, or t
  modified_base (557)..(559): a, c, t, g, unknown or other
  misc_feature (557)..(559): n is a, c, g, or t
tcagtagtgtagatcacgaccggtgctcgatttagtagtcgcataaagggaagggactggagtgggtctcaggtattggtggcagtggtgagacacatactacgcagactccgtgaagggccggttcaccatctccagagacaattccaagaanaccctgtctctgcaaatgaacaacctgagnccgaggacacggcctatattactgtacgaaaaatggacctaggatangactactagttggacttgtactcgatctgtgggccgtgccgtacctggtcactgtctccgtcagcctcaaccccgagggccctatccggcccttttcccccgnggcccgcccttgcctaccgnggtaccgccaacccgttcggacgacgcaccgacgccggtcccgtnacgacgtttcgcgttcgggtaacaacgggtaccttaccctttaccgaacttcccgttaaacctacttacgtcggtaacgggcgggcgttggaacccgaaggggccctaaggacgttnancgacngtnnatnnannnnnnnnnnnnnncnnnctnnntnnn

SEQ ID NO: 61948 - DNA, 520 bp, Homo sapiens
  misc_feature: GYAE6OF02J2DA8.37.62.F07.1.454.CMB.1.raw
  modified_base (491)..(493): a, c, t, g, unknown or other
  misc_feature (491)..(493): n is a, c, g, or t
  modified_base (495)..(520): a, c, t, g, unknown or other
  misc_feature (495)..(520): n is a, c, g, or t
tcagtagtgtagatcacgaccggtgctcgatttagtagtcgcataaagggaaaggggactggagtggggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatcgactatattgggactggtacttcgatctcgtggggccgtggcacccgtggtcactgtctcctcacgcctccaccgaagggccccagtccggtccttccccgtcggccgcccctgcctacccaggtaccgccacccgtcccggagtacgccacgacggcccgggtccctggggcctcggcctcgggtacaacggtcctaccttcccattcctactaacctgtcggagggccgggcgcggacaggcgacgagagnnngnnnnnnnnnnnnnnnnnnnnnnnnnn

SEQ ID NO: 61949 - DNA, 571 bp, Homo sapiens
  misc_feature: GYAE6OF02GJUZJ.37.62.F07.1.454.CMB.1.raw
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(524): a, c, t, g, unknown or other
  misc_feature (523)..(524): n is a, c, g, or t
  modified_base (529)..(529): a, c, t, g, unknown or other
  misc_feature (529)..(529): n is a, c, g, or t
  modified_base (538)..(538): a, c, t, g, unknown or other
  misc_feature (538)..(538): n is a, c, g, or t
  modified_base (540)..(542): a, c, t, g, unknown or other
  misc_feature (540)..(542): n is a, c, g, or t
  modified_base (545)..(545): a, c, t, g, unknown or other
  misc_feature (545)..(545): n is a, c, g, or t
  modified_base (547)..(548): a, c, t, g, unknown or other
  misc_feature (547)..(548): n is a, c, g, or t
  modified_base (551)..(552): a, c, t, g, unknown or other
  misc_feature (551)..(552): n is a, c, g, or t
  modified_base (555)..(556): a, c, t, g, unknown or other
  misc_feature (555)..(556): n is a, c, g, or t
  modified_base (558)..(561): a, c, t, g, unknown or other
  misc_feature (558)..(561): n is a, c, g, or t
  modified_base (563)..(565): a, c, t, g, unknown or other
  misc_feature (563)..(565): n is a, c, g, or t
  modified_base (568)..(570): a, c, t, g, unknown or other
  misc_feature (568)..(570): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattattgtgcgaaagtggtggggggagtgggggctactccgtggtcgttttgactacgtcggggccagggacgtcccgtggtccaccggttctcctcacgcctccaccgaacgggccctagtccggtcccttcccccgtggcccgtccctgcccgtccgagggacgtcctacccgtccggaagacgccaacgacggcccggtcccgtggggtcctcgccgttgggtacaaacgggtaccttacgttcctacgttcctaaccacgttaccgtagggacggtccgggctacgggacgaacggccgactagtcggcnancannagcgngactcagcnannncgnanncgnncgnncnnnncnnnacnnnc

SEQ ID NO: 61950 - DNA, 676 bp, Homo sapiens
  misc_feature: GYAE6OF02FU03T.37.62.F07.1.454.CMB.1.raw
  modified_base (407)..(407): a, c, t, g, unknown or other
  misc_feature (407)..(407): n is a, c, g, or t
  modified_base (617)..(617): a, c, t, g, unknown or other
  misc_feature (617)..(617): n is a, c, g, or t
  modified_base (625)..(625): a, c, t, g, unknown or other
  misc_feature (625)..(625): n is a, c, g, or t
  modified_base (632)..(632): a, c, t, g, unknown or other
  misc_feature (632)..(632): n is a, c, g, or t
  modified_base (637)..(637): a, c, t, g, unknown or other
  misc_feature (637)..(637): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (666)..(666): a, c, t, g, unknown or other
  misc_feature (666)..(666): n is a, c, g, or t
  modified_base (674)..(674): a, c, t, g, unknown or other
  misc_feature (674)..(674): n is a, c, g, or t
tcagtagtgtagatcacgaccggtgctcgattttagtagtcgcataaagggtaagggtacgtggacgtgggtctcgaggtattgggtggcaggtggtgaggaccgaccattactacgcagacgtccgtgaagggccggtttcaccatcgtccacgaggacaattccaagaacacctgtctcctgtcaaatgaacaacctgacgagtccgaggtacacggccctagtagttactgtacgaaaattcggaccttacggattagtcggacctacgttagttaggggacttagggttacttccggattccttcgtcggggtccgttggccacccgttggtacaccttggtacctcgtaccaggtccctacctaccgaacgggtccccaagttccggttccctttccccggnggtcccgtacccttgcctacgtacgggacggtccaccgttccgacggacgtccacgaccggccgggtccccgtggggtacctcggacccgttgggtaccgaaacgtacctttaccgttccgtaacttaccttaaccgaactttacgcggtaacggccgggtacgtacggacgtaacggttcggacctaagtacggtcagtcgacagtccngactcgtntacgtcntcgancgtcnangacngacgtcgncngaccgtancgtctcgntc

SEQ ID NO: 61951 - DNA, 615 bp, Homo sapiens
  misc_feature: GYAE6OF02HDDOZ.37.62.F07.1.454.CMB.1.raw
  modified_base (581)..(581): a, c, t, g, unknown or other
  misc_feature (581)..(581): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(615): a, c, t, g, unknown or other
  misc_feature (590)..(615): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatcctccagagacaattccaagaacaccctgtctctgcaaatgaacaacctgagagccgaggacacggccctatattactgtaacgaaaatggcctacggatatgactactattgggactggtacttcgatcgtctggggccgtggccacccgtggtcactgtcctccctcacgtccctacccgaacccgaacggggcccctacgtccgggttacccttccccccgtgggccccgccccgttgcccgttaccgagggacgcccgaaccccgtccggaacggacgccaaccgacggtcccgggaccccgttcggggccttcgcccgttcgggtaccgaaacggtacctttaccgttccaacttaccctaacctaaccgttaccggtcggaccgggtcggggtaccgttaggggaacccgaacgggtccggaacctaacggttaagcgacntcagncngnnnnnnnnnnnnnnnnnnnnnnnnnn

SEQ ID NO: 61952 - DNA, 626 bp, Homo sapiens
  misc_feature: GYAE6OF02G4S5M.37.62.F07.1.454.CMB.1.raw
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (539)..(539): a, c, t, g, unknown or other
  misc_feature (539)..(539): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (586)..(587): a, c, t, g, unknown or other
  misc_feature (586)..(587): n is a, c, g, or t
  modified_base (595)..(596): a, c, t, g, unknown or other
  misc_feature (595)..(596): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(611): a, c, t, g, unknown or other
  misc_feature (607)..(611): n is a, c, g, or t
  modified_base (613)..(613): a, c, t, g, unknown or other
  misc_feature (613)..(613): n is a, c, g, or t
  modified_base (615)..(624): a, c, t, g, unknown or other
  misc_feature (615)..(624): n is a, c, g, or t
tcagtagtgtagatcacgaccggtgctcgatttagtagtcgcataaagggaaagggactggagtgggtctcaggtattggtggcagtgggtgagaccacatactacgcagactccgtgaagggccggttcaccatctccagagacaattccaaagaacaccctgtctctgcaaatgaaacaacctgagagccgagacacggtaccctatatactagtaacgaaaatggcctaacggatatgacttaactagttcggtagttggtaacttcgatcgtcgtgggggcctgggccaccgtggtcctacgtgttcctcctcacgccctccaaccgaacgggaccctagttcccggttcccttcccccgtcggacccggtccctcgcccgttacccgagggtaccnccgtaccctccgaacgngacctacggcgtcccgggccttacggggctacgtccgtcgggtaactaacggggtaacctttcccgtttaccgaacttcccgttaaacctaccgttaacgggtcgaaccggggtcccgggngttccggggaaaccgaacggtccggaccgttaacgtacgggncncgnnacgctcgnnacgcncnancnnnnncngnnnnnnnnnncg

SEQ ID NO: 61953 - DNA, 708 bp, Homo sapiens
  misc_feature: GYAE6OF02GQHLK.37.62.F07.1.454.CMB.1.raw
  modified_base (629)..(629): a, c, t, g, unknown or other
  misc_feature (629)..(629): n is a, c, g, or t
  modified_base (641)..(641): a, c, t, g, unknown or other
  misc_feature (641)..(641): n is a, c, g, or t
  modified_base (660)..(660): a, c, t, g, unknown or other
  misc_feature (660)..(660): n is a, c, g, or t
  modified_base (665)..(665): a, c, t, g, unknown or other
  misc_feature (665)..(665): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaaccaccctgtctctgacaaatgaacaacctgagacgccgaggacacggccctatattactgtaacgaaatcggacctacggatatgactactagtggactaggtacttcgatctcgtcggggccgtcggacctacccgtggtcctacgttcgttccctccgttacgacggtccccttacccgaaaccggtaaccggggccctacgttcccgggttacccctttccccccggtgggtacccctaccccttcccgtaccgaaacggtcgtacccgtacccgttaccgggtacggggggtacctaccggtacggggcccggtacccgggtggggtcccttcgggtcccgttaggggtaccgtaaacggggttacccttaccgttacccactttaccgtaacctaccgttacggtacggacgggtccgggtcgtacgggtaccgaccgggacgacgtaacgttacggactcgacgactnacgtagacgcgngtcgcgtcgtcgcgcgagngacgntacgcgtcgacgtcgacgtacagtacgtcagtgtcgtagtatc

SEQ ID NO: 61954 - DNA, 578 bp, Homo sapiens
  misc_feature: GYAE6OF02HLDRQ.37.62.F07.1.454.CMB.1.raw
  modified_base (347)..(347): a, c, t, g, unknown or other
  misc_feature (347)..(347): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (551)..(553): a, c, t, g, unknown or other
  misc_feature (551)..(553): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
  modified_base (573)..(578): a, c, t, g, unknown or other
  misc_feature (573)..(578): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgacaaatgaacaacctgagagccgaggacacggccctatattactgtaacgaaatggacctacggatatgacttactattgggactggtacttacgatctcgtgggccgtgacacctggtcactgtctcctcacgcctacaccgacggccctacgtaccgtcccttccccgtaggtcccncccgttgcctacccgacggaccgtccaccgtccggacgtacgtacaccgagggcccggcccgtcgggtctacggccgttacggtcgaaacgtaccttacttaccgattaccctaagaaccttcgtacggccggtacgggccgttaggaccggaacggccgaacgttagaccggtnancgtcgnacgtgatacgngtngtcncgnnnagcgacgcncnacgcagnannnnnn

SEQ ID NO: 61955 - DNA, 645 bp, Homo sapiens
  misc_feature: GYAE6OF02IWUT8.37.62.F07.1.454.CMB.1.raw
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
  modified_base (187)..(187): a, c, t, g, unknown or other
  misc_feature (187)..(187): n is a, c, g, or t
  modified_base (545)..(545): a, c, t, g, unknown or other
  misc_feature (545)..(545): n is a, c, g, or t
  modified_base (553)..(553): a, c, t, g, unknown or other
  misc_feature (553)..(553): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
  modified_base (628)..(628): a, c, t, g, unknown or other
  misc_feature (628)..(628): n is a, c, g, or t
  modified_base (635)..(635): a, c, t, g, unknown or other
  misc_feature (635)..(635): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaaccaccctgtcnctganaaatgaacactgagngccgaggacacggaccctatattacgtagtaacgaaaagtcggcctaaggatataggaattacgtagtggtactaggtacttacgactcctcggtcgggtccgtaggacctaccgtaggtacctacgtcgtcctccgtacgaccgtcctaccaccgaaacgggcctaacggtccggtaccctccccgcgggccacccgtcggtaccgtaccgaggaccgtcctaacccgtcgaacgcgtacaccgacggccggtccgtcggtcctcggtactaccggaacgaaacgttcccttaactcctaactaccctaacaccgtacggtcggacggtccggacgtcgggaccgtaaggccgtaanaacgtggnacgtncgntcngancctanagatcgatcgatacgcgagttaactgggacctaagggtaactcctagcaacctttnaaccgtntacggctaag

SEQ ID NO: 61956 - DNA, 575 bp, Homo sapiens
  misc_feature: GYAE6OF02GI6JB.37.62.F07.1.454.CMB.1.raw
  modified_base (343)..(343): a, c, t, g, unknown or other
  misc_feature (343)..(343): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
  modified_base (573)..(574): a, c, t, g, unknown or other
  misc_feature (573)..(574): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattactgtaacgaaaatggcctacggatatgactactatgggactggtacttgatctcgtcggggccgtggcacccgtggtcactgtcctcctcacgccctccaccgaacgggcccctagtccggttcccttccccggnggtccgccctgcctccgaggacgacctaccgtccggagacgccaaccgacggccgggtcccgtgggaccgtcggtcccgttggtaccaaaggtaccctttacgttccgacttacctaccgtacttacgtcggaacgggtcgggacgtcgggaacgacgggtacgaccagtacgntcgangcgatgcagnngncncncacncgacngtcgngcancacgngcncgcgnctnnc

SEQ ID NO: 61957 - DNA, 571 bp, Homo sapiens
  misc_feature: GYAE6OF02HBRS2.37.62.F07.1.454.CMB.1.raw
  modified_base (162)..(162): a, c, t, g, unknown or other
  misc_feature (162)..(162): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (539)..(571): a, c, t, g, unknown or other
  misc_feature (539)..(571): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatctccagagacaattccaagaatacggtntatctaggaaatgaacagcctgagagccgaaggaccacggtccctctaattacctgtcgcgagagatcaggacggatagtagcagtcagcctcgtgacgtacggtcggggcctaaccggaacccgtggtccaccgttcctccncgacgccctccgaaccgacggccccagttcccggtcccttcccccggngccccgtacccccttcccgtaaccaagaccgacccgtaccccgtcgggtcggggaccacggtacgcccgggtacccgtcgggctccggccgtggtaaccgagttaaccctaccttcctacgttacctaccgtaactacgtcgaagggtccgtacggacggacgtaacggcccttaagagtaccgannnnnnnnnnnnnnnnnnnnnnnnnnnnnnnnn

SEQ ID NO: 61958 - DNA, 694 bp, Homo sapiens
  misc_feature: GYAE6OF02IGKC3.37.62.F07.1.454.CMB.1.raw
  modified_base (193)..(193): a, c, t, g, unknown or other
  misc_feature (193)..(193): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (592)..(592): a, c, t, g, unknown or other
  misc_feature (592)..(592): n is a, c, g, or t
  modified_base (604)..(604): a, c, t, g, unknown or other
  misc_feature (604)..(604): n is a, c, g, or t
  modified_base (620)..(620): a, c, t, g, unknown or other
  misc_feature (620)..(620): n is a, c, g, or t
tcagtagtgtagatcacgaccggtgctcgatttagtagtcgcataaagggaaagggactggagtgggtctcaggtattggtggcagtggtgagaccacatactacgcaggactccgtgaaggccggttcaccatctccagagacattccagaacaccctgtctctgacaattgaacacctgagagccgagacncggcctatacttactgaacgaaaatcggactacggatagtgactactattagggcttggtactcggacttctcgtgggccgtgccgtaccgtcggtaacnccgttgtacctcccgtnaacgttacccnccgaccaacggggtccctagttccggttcctcccccgtaggttcccnccccgtttagacccgttaccgacgggaacncccgttaacccgttaccggaaggacggccaacgttacggtcccgccccggtaaggccgttccggcccttcgggtaaacgtaaaccggtcctagttacccccgtataaccctttcgaaccgtttagaccgtaggtcccgggtacgttaccggtacgtaaccggacgtaccgttaagggcctggtaatccgaacgngttccgaacgcncgagtacgtacgtacncgtacgactacgacgtacgtcgtacgtacgtacgtcgtacgtcgtacgtcgacgtacgtacgtacgtacgtacg

SEQ ID NO: 61959 - DNA, 592 bp, Homo sapiens
  misc_feature: GYAE6OF02IG2PF.37.62.F07.1.454.CMB.1.raw
  modified_base (335)..(335): a, c, t, g, unknown or other
  misc_feature (335)..(335): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (543)..(544): a, c, t, g, unknown or other
  misc_feature (543)..(544): n is a, c, g, or t
  modified_base (551)..(551): a, c, t, g, unknown or other
  misc_feature (551)..(551): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (567)..(568): a, c, t, g, unknown or other
  misc_feature (567)..(568): n is a, c, g, or t
  modified_base (574)..(574): a, c, t, g, unknown or other
  misc_feature (574)..(574): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattactgtacgaaaatggcctaggatatgactactattcgggactggtacttcgatctcgtgggccgtggcaccctggtcactgtctcctcacgcctaccaccgaagggcccagtccggtccttccccgnggccgcccgtgcctccgaggtacgccacctaccggagacgccaacgacggtccgggtacccgttggggccttcggccgttacgggtaccaaacgggtaccttacctttacccgtacttaccttaccgtaacttacgtacggaacgggtcggggtacgtcggaacggaacggtccggaacgtacgtaacgcgactgtacgntnactcgnngctcgcncgatgtcncagngtanncgtcanagcgctacncncncgntn

SEQ ID NO: 61960 - DNA, 547 bp, Homo sapiens
  misc_feature: GYAE6OF02JAUE0.37.62.F07.1.454.CMB.1.raw
  modified_base (291)..(291): a, c, t, g, unknown or other
  misc_feature (291)..(291): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (517)..(518): a, c, t, g, unknown or other
  misc_feature (517)..(518): n is a, c, g, or t
  modified_base (523)..(526): a, c, t, g, unknown or other
  misc_feature (523)..(526): n is a, c, g, or t
  modified_base (528)..(528): a, c, t, g, unknown or other
  misc_feature (528)..(528): n is a, c, g, or t
  modified_base (534)..(539): a, c, t, g, unknown or other
  misc_feature (534)..(539): n is a, c, g, or t
  modified_base (541)..(543): a, c, t, g, unknown or other
  misc_feature (541)..(543): n is a, c, g, or t
  modified_base (545)..(547): a, c, t, g, unknown or other
  misc_feature (545)..(547): n is a, c, g, or t
tcagtagtgtagatcacgaccggtgctcgatttagtagtcgcataaagggaaagggactggagtgggtctcaggtattggtggcagtggtgagaccacatactagcagactccggtgaagggtcccggttcaccatctccagagacaattccaagaacaccctgtcctactgcaaactgaacaacctgagagccgacgacacggcctatatactaaccgaaatggctacggatatgactactacttgggactggtacttcgatctctggggccgtaggcgaccctggtacnctcgtctcctcaacgcctccaccaagggcccgatccggtcgttacccctggccgtccctcggctccgtacgacgaccgcctaccgcgacggtccacgacggcgcccgtacgggcgtacgccttcggcgaacggtacctacgtttacccagtctaaccgtcgtaacgttcgagtaccgggacgtcggcctacgggcgcgtactagcacngcngtngntagnacgtcnnacgtnnnngngcaccnnnnnncnnngnnn

SEQ ID NO: 61961 - DNA, 559 bp, Homo sapiens
  misc_feature: GYAE6OF02IXMEQ.37.62.F07.1.454.CMB.1.raw
  modified_base (263)..(263): a, c, t, g, unknown or other
  misc_feature (263)..(263): n is a, c, g, or t
  modified_base (352)..(352): a, c, t, g, unknown or other
  misc_feature (352)..(352): n is a, c, g, or t
  modified_base (523)..(524): a, c, t, g, unknown or other
  misc_feature (523)..(524): n is a, c, g, or t
  modified_base (528)..(539): a, c, t, g, unknown or other
  misc_feature (528)..(539): n is a, c, g, or t
  modified_base (541)..(559): a, c, t, g, unknown or other
  misc_feature (541)..(559): n is a, c, g, or t
tcagtagtgtagatcacgaccggtgctcgatttagtagtcgcataaagggaaagggactggagtgggtctcaggtattggtggcagtggtgagaccacatactacgcagactccgtgaagggccggttcaccatcctccagagacaattccaagaacaccctgtctctgcaaatgaacaacctgagagccgaggacacggccctatattactgtaacgaaaatggcctaggatatgactactatgggactggtactcgatctntgggccgtgcacctggtcacgtgtctcctcacgcctcccaccgacgggccccagtccggtcccttcccccgtcggccgtcccctcgccnccctagggcacctccgtaccggagacgacaccgacggccgggtccccgtcgggccgttcggtcccgtggggtacccgtaaacggggacctttaccgtttcccacttcctaaccgaccttacgtcggtaacgggtccgggaccttgggaccgaacggcgacgtaagtacggnngacnnnnnnnnnnnngnnnnnnnnnnnnnnnnnnn

SEQ ID NO: 61962 - DNA, 556 bp, Homo sapiens
  misc_feature: GYAE6OF02HQSNP.37.62.F07.1.454.CMB.1.raw
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
  modified_base (526)..(527): a, c, t, g, unknown or other
  misc_feature (526)..(527): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (555)..(555): a, c, t, g, unknown or other
  misc_feature (555)..(555): n is a, c, g, or t
tcagtagtgtagatcacgaccggtgctcgatttagtagtcgcataaaagggaaagggactggagtgggtctcaggtattggtggcagtggtgagaccacatactacgcagactccgtgaagggccggttcaccatctccagagacaattccaaagaacaccctgtctctgcaaatgaacaacctgaagagccgagacacggccctaatattactgtaacgaaaagtcggcctaacggatatcgaacttactagttagggactggtaccttcgactcgtacgtggggccgtggcctaccctggtcacttgtcctcgcacgtcctaccaacccgacgggccctacgtccggtccttccccgngccgccctgcctccaggcncgaccncgagngaccacacggccgacccgtggcctcgccgtggacgaggccttacttccgactctacacttagtcggacgcggcgtcggagtacgggctacgacgtacgntgctgacntacgagactgtanaacgcttngcgcgtcnncgcagacncncgagacncngnactacana

SEQ ID NO: 61963 - DNA, 486 bp, Homo sapiens
  misc_feature: GYAE6OF01AWGBE.34.10.A10.1.454.CMB.1.raw
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaattgggggataaatatgtttgctggtatcagcagaagccaggccagtccccctgtgatggtcatctatcaagattataagcggccctctgggatccctgagcgattcactggctccatctctgggaacacgagccactctacgaccatcgagccgggaccaggctatagatgagctgactattacgtgtcagacgtggacagcaccagtgtgcgtcgtcggcggagggaccgagctcgaccgtcctaggtcacgcccaggtcccg

SEQ ID NO: 61964 - DNA, 629 bp, Homo sapiens
  misc_feature: GYAE6OF01EBBKY.34.10.A10.1.454.CMB.1.raw
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatactccccaggacagacagccagcatcacctgctcaggagataaagtggggataaatatgtttgcgtggtatcagcagaagccgaggccacgtcccctgtcgagtggtcagtctatacaagtaattaagtaacgccggtaccctcgtagggtactcccgtgacgcgtattcactcggcctccattcctcgtacgggaacctacacgacctacttcctacgaacctacgtccgaacgggtacccgggaacccgacggtacgtaacgtaggaacgttacggaacggtcctaaggtaactttagttaccgttggttacgacggtaccgggtagggaaccgagacccaaccgtacgttggtacgtcgttaccggttacggggaccgggtacgggaaccaacggtcgtaaccggtacccgtaccgttacggacccgacgtacccgaacggtccccg

SEQ ID NO: 61965 - DNA, 495 bp, Homo sapiens
  misc_feature: GYAE6OF01A2O3E.34.10.A10.1.454.CMB.1.raw
  modified_base (294)..(294): a, c, t, g, unknown or other
  misc_feature (294)..(294): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcagagataaattggggataaatatgttgctggtatcagcagaagccaggccagtcccctgtgatggtcatctatcaagattanaagcggccctgtgggatcccgtagagcgattcactggctccatctctggaacacgagccactctagaccatccaggaccggacccaggctaatagatgaggctacgactattactgtcagtacggtggacagccacactgtgtcctcgttcgggcggagggaccagcgtcgaccgtccgtagtccacgcccgaaggtcccg

SEQ ID NO: 61966 - DNA, 652 bp, Homo sapiens
  misc_feature: GYAE6OF01BGSQ9.34.10.A10.1.454.CMB.1.raw
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagcccaccctcagtgtccatactccccgaggacagacagccagcatcacctgctcgagagataagtgggaataatagtgttgctggtatcagcgaagacgccgaggcctacgtccccgtgtgagtcggtcagtctatactaagtattaacgtaacggcccggtccctacgtacgggtacctcccgtagacgtcgtaattccgtagtcggtcctaccacgtccgtacggtacggaaccacacgtaccctaactccgtacgaacctacgtaaccggaccggacccggggaaccctagggtacccttaagtacgggtaacgtacggtacggtcttaagtaactttaacgttacgtacgtacgaacggtacgggtacgaacgtacgtaccgacgtacgtcgtacgtccgtccggttacgggacggtaccggtaccgtaaggttccgaccggttaacccgtcggtaacggaccgaacccggcccgtacgtcccccgg

SEQ ID NO: 61967 - DNA, 648 bp, Homo sapiens
  misc_feature: GYAE6OF01C8ILB.34.10.A10.1.454.CMB.1.raw
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatactccccaggacagacagccagcatcacctgctcgaggagagtaaagttgggggaataaatagttgtttgcgtggtatcgagacgaagaacgccgaggcccacgttcccctggtgagtggtcactctatacgtaagtattaacgtaacggtccggtcccctcggtacgggtacctcccgtaggacgacgtacgttccgtacgtcggccttacctacgttcgtacgtacgggaaccacgaccgcctactcgtacgaccgtactacggacggtacccgggaacccagggtactaagtaggtacgtagggacggtcttaacggttaacttaacgtttaaccgtcggtaacgtacgggtaaccgggtacgggaaccacggtacccaaccgtcgtcggtcgtccgtcggtaccgggacgggtacggaccacggtccgtacggacccgtcggtagacctccgaccgtacgtcccg

SEQ ID NO: 61968 - DNA, 498 bp, Homo sapiens
  misc_feature: GYAE6OF01BIRRI.34.10.A10.1.454.CMB.1.raw
  modified_base (381)..(381): a, c, t, g, unknown or other
  misc_feature (381)..(381): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaattgggggataaatatgtttgctggtatcagcagaagccaggccagtcccctgtgatggtcatctatcaagattataagcggccctctgggatccctgagcgattcatggctccatctctggaacacagccactctgaccatcagccgggaccaggctanagatgagctagactattagtcgtacagacgtgggacagcaccacgtgtcgtctcgttcgggcggtagggacccgaaggcctcggacccgtccgtaggtaccacggcccaaggtcccg

SEQ ID NO: 61969 - DNA, 706 bp, Homo sapiens
  misc_feature: GYAE6OF01CRB0Z.34.10.A10.1.454.CMB.1.raw
  modified_base (186)..(186): a, c, t, g, unknown or other
  misc_feature (186)..(186): n is a, c, g, or t
  modified_base (331)..(331): a, c, t, g, unknown or other
  misc_feature (331)..(331): n is a, c, g, or t
  modified_base (604)..(604): a, c, t, g, unknown or other
  misc_feature (604)..(604): n is a, c, g, or t
tcagtacacgtgatcacgaccggtgctcgatttagcgtcgatctcaggggctgggcctcaggaagcagcatcggaggtgcctccgccatggcatggactccctctcttcctcggcgtccttgcttactgcacaggatccgtggcctcctatcgacctgactcacgcccaccctcagtctccatacncccgaggacagacagccagcatccacctgctacgaaggagtaaattaaaggtagggggtaaattaaagttagttggtttagtcgttaggttactcgaggaccgaaggaacgtccgaacggtaccctaccgtcccgtagtacggtnttacggtctaaacgtctaactagtaaacgtaattaacgtaaccggccggtcccgttacggtacgggaccgtttcccgaggtaacgtacgttacgttccgtaaccgtcgtcctaccgtaacgtttcccgtagtaacggaaacaccgacgtacccctactaccgtacgtaccgtacgtaccggacggtacccgggaactaacgggtactaacggtaagtgacgggtagtacgttacgtaacttacgttaccgtagtacgacggacggtacgaacncgtacacggtctacgtcggtacctcgggtaccgggaggtaacggaaccgttcggaccgtaccggtaccgtcggtacggaccgaccgtcccgtacggtccccg

SEQ ID NO: 61970 - DNA, 681 bp, Homo sapiens
  misc_feature: GYAE6OF01CFNOA.34.10.A10.1.454.CMB.1.raw
  modified_base (249)..(249): a, c, t, g, unknown or other
  misc_feature (249)..(249): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatactccccaggacagacacgccagcatcacctgctcaggagataaagtggggaataatatgttgctgtatnagacgagaacgccgacggccacgttccccgtgtacgagttggtctacgtactagtactaagtacttaacgtaacgtaccggtcccctcgtacgggtactaccgtggacgtcgtacttacgacgtacggtcctccgtactcgtcggtacggtaacacgactacccactaccgtcgaacctacgtacgacccggtaccgggaacccaagggtacttaacgtaaacggtgttacgggtacggtaccgttaagtaaccgttaaactttaccggttccggaacggtaaccggtaacggggttcggaaacccgacgttaccgaaccttaacggtcgttaacggtcccgttaacggttccgggaccgggaacggtacccgcggtaccgtaccggtacccgttacgtaccggtcgaccggtaccccgtacggtaccccgg

SEQ ID NO: 61971 - DNA, 818 bp, Homo sapiens
  misc_feature: GYAE6OF01BQPG7.34.10.A10.1.454.CMB.1.raw
  modified_base (253)..(253): a, c, t, g, unknown or other
  misc_feature (253)..(253): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacgaggatccgtggcctcctatgacctgactcacgccaccctcagtgtccatactccccaggacagacagccagcactcacctgcctacgagagaagtaagttggggaataagtagtgtttcgngttaggtatacgagtcgaacgacgaccgacggcccgtacgtcccccgtgtagtacgtaggtactactacttaacgtacgaaacgttaacgttaagtaaacccggcccggttacccgttacgggtacgggtaacccgttcccgtagggtacggaccgttaacgttaccgtacgttaccggtaaccttccgtaaacgtttcccgtaccgggttaacggaaacccaacgtacccggtaccctaaccgttaccttacgaacctaccgtacggaacccgggtaccgggaaccctaggtaacccgttaagtaaccggagtacgggtaactacggttaacgttaaccgttaatttaaccgacggttaccggaacgggttaccgggtaacgggaaaccgtacgaccccgtacggttacccgtccggttaccgtttccccggtaggggtacccgggggttaacccgggaaacgggggtacccgtaaacgggttacccggtaaccgggttacccccggttaccggggtacgtaaccccggtaacccggaccccggtaacccgggttccccccggg

SEQ ID NO: 61972 - DNA, 684 bp, Homo sapiens
  misc_feature: GYAE6OF01A3FWE.34.10.A10.1.454.CMB.1.raw
  modified_base (188)..(188): a, c, t, g, unknown or other
  misc_feature (188)..(188): n is a, c, g, or t
  modified_base (266)..(266): a, c, t, g, unknown or other
  misc_feature (266)..(266): n is a, c, g, or t
  modified_base (343)..(343): a, c, t, g, unknown or other
  misc_feature (343)..(343): n is a, c, g, or t
  modified_base (633)..(633): a, c, t, g, unknown or other
  misc_feature (633)..(633): n is a, c, g, or t
  modified_base (667)..(667): a, c, t, g, unknown or other
  misc_feature (667)..(667): n is a, c, g, or t
tcagtacacgtgatcacgaccggtgctcgatttagcgtcgatctcaggggcgtgggcctcaggaagcagcatcggaggtgcctccgccatggcatggatccctctcttcctcggcgtccttgcttactgcacaggactccgtggcctcctatgacctgactcacgcccaccctcagtcgtccattacnccccgaggacagacacgccatcatccacctgcctacgaggagtaataaaggttagggggaataaattagttggtttanaccgttggtactacgagacaaggaacgcccgaaggccctacggtcccctggtacggagtcggtacctataccgttanacgtaaggtattagtaacgcccggtaccttacgtggacctccgaggtacacgtattccgacgtcgctcctagtcctagtacggaccacgtacgaccttacgtacaccggtaacctagtaaccccgggacggtaccccgggtaaccccgtaagggttacctaaccgtaggggtaaacgttggacccgggttataaccgggttaactttaacgtttacgtacggtaacgtaacggtccgggtaaagggcctaaccggccctacgacttggtcgtacccggttgtaccggggnggacctaacggctcgaacgtccgttagcgtaccncggaccgtcggtacccg

SEQ ID NO: 61973 - DNA, 652 bp, Homo sapiens
  misc_feature: GYAE6OF01CG7US.34.10.A10.1.454.CMB.1.raw
  modified_base (217)..(217): a, c, t, g, unknown or other
  misc_feature (217)..(217): n is a, c, g, or t
  modified_base (566)..(566): a, c, t, g, unknown or other
  misc_feature (566)..(566): n is a, c, g, or t
  modified_base (638)..(638): a, c, t, g, unknown or other
  misc_feature (638)..(638): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcacgccacctcagtgtccatactcccgaggacagacagccagcatcactgctcagganagtaagtgggaataagtagtgtttagcttaggtatcgagtagagaacgccgacggcctacgtcccctggtacgagtcggtactatactaactacgtaaagtaacttaacgtaacggcccgtaccgtcggtacgggtacgtccccgtaggacgtacctaacgtttccaacgttcggtacctacgtacgttacgtacggtaacgggtaaccaaccggaccgtacctaaccgttccgaacgtacccgtacgttaccggaacgggtacccggaaccgtacggtacttaagaggtacgtaggtacgacttacggtaacttaacgttcgtacggtaccgtacgtacggcggaacncgtacccgacctagtgtaccgtccgtcggtacggcggtagaccgtacgcgtccgaccgtcgacgacgtaccnccggtaccgtcccg

SEQ ID NO: 61974 - DNA, 592 bp, Homo sapiens
  misc_feature: GYAE6OF02INOEF.34.10.A10.1.454.CMB.1.raw
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcacgccaccctcagtgtccatactccccaggacagacagccagcatcacctgctcagganataagttggggataaagtatgtttgctggtatcagcaagaacnccgaggccacgtcccctgtgatggtctactctatacaagtattaagtaacggccgtccgtacgttcgggacctccgtagacgtacgtattaccgacgtggacctacctaactcgtacgtacgggaacctacgtacgacctaactccgtacgaaccgatccggaggtacccgggaaccacggacctaagtacgagtcggtacggctaagtactagttactaggtaccacggaacgtggaactcgactaccgagtcgtacgccttacggtacggaccgggtacggaccaaagtccgacgtaccgtcggagacccgtacgaccggagtccccg

SEQ ID NO: 61975 - DNA, 626 bp, Homo sapiens
  misc_feature: GYAE6OF02HJDP9.34.10.A10.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (521)..(521): a, c, t, g, unknown or other
  misc_feature (521)..(521): n is a, c, g, or t
tcagtacacgtgatcacgaccggtgctcgatttagcgtcgatctcagggcgtgggcctcgaggaagcagcatcggaggtgcctccgccatggcatggatccctctcttcctcgcgtccttgcttatgcacaggatccgtgcctctatcgacctgctcacgccaccctcncgtntaccatactccccaggcagacacgccagcatcgacctgcctnagganaagtaagttaggggataaactagttcgtttgngtggtatcagnagagctacggcacgtccccgnttgactggcctatacctatcaagtattaagaaagccgtacctcgtcgggtaatcccgtagcgacgtattccagttcggacttcgctacgttcgacgggacagacgccacttccganaaccgtancgacgccggtaacccgaggtacctaagagtataaggcgtaaccgtggaaacctacgtttaacgagttccgaagtaaccgggtggaacccgagccgttaaccgaagtttccggngtaccgtttcccggtgggggtaacccggtacgggtaacgaccggtaccgttagggaacccttcgggttaaccgtacggtaaccgtccccggaaaggttcccccgg

SEQ ID NO: 61976 - DNA, 530 bp, Homo sapiens
  misc_feature: GYAE6OF02HNALU.34.10.A10.1.454.CMB.1.raw
  modified_base (304)..(304): a, c, t, g, unknown or other
  misc_feature (304)..(304): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaattggggataaatatgttgctggtatcagcagaagcaggccagtcccctgtgatggtcatctatcaagattataagcggcctntgggactcctgagcgattcactggctcatctctggacacagccactctgaccatcgagccgggaccaggactagtagatgagctagactattactgtacagtaccgtagggacacgccaccgtaactgtacgaccttcggttcccggggtacgggacgggtacccgaacggtccgtaccggacccggttaccgtacgggtccaaccggtacccgaaggtaccccgg

SEQ ID NO: 61977 - DNA, 500 bp, Homo sapiens
  misc_feature: GYAE6OF02IQ7U0.34.10.A10.1.454.CMB.1.raw
  modified_base (308)..(308): a, c, t, g, unknown or other
  misc_feature (308)..(308): n is a, c, g, or t
  modified_base (414)..(414): a, c, t, g, unknown or other
  misc_feature (414)..(414): n is a, c, g, or t
tcagtacacgtgatcacgaccggtgctcgatttagcgtcgatctcagggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaattggggataaatatgtttgctggtatcagcagaagccaggccagtcccctgtgatggtcatctatcaagattataagcggccctntgggactccgtgagcgattcactggctcatctcgtagggaacacagccactctgaccatcaggccgggacccaggctagtagatggacgctagactattactgtanagacgtggacagcacactgtgcgtcgtcgggacggacggaccaagtccgtacgaccgttccgtagtccgacgacccgaaggtcccg

SEQ ID NO: 61978 - DNA, 568 bp, Homo sapiens
  misc_feature: GYAE6OF02GAX3W.34.10.A10.1.454.CMB.1.raw
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaattggggataaatatgtttgctggtatcagcagagccaggccacgtcccctgtgatggtcatctatcaagtattaataaacgccggcccttcgtggggactccccgttgacgcgtattcacgttggcctcatcctcgtacgggaactacgacgcccactctcgacctatcacggcgggaccccagggctagtacgagtgacggtctgtacttactttacgtcgtacgaggtacggtgggaacacgaccacccgtacgtgtcgccgttacgtccgggacgggacgggaacccgaaggtccgtacggacccggttccgtacgggtccgaccggtacccgaggtccccgg

SEQ ID NO: 61979 - DNA, 694 bp, Homo sapiens
  misc_feature: GYAE6OF02GCSTZ.34.10.A10.1.454.CMB.1.raw
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
tcagtacacgtgatcacgaccggtgctcgatttagcgtcgatctcagggcgtgggcctcaggaagcagcatcggaggtgcctccgccatggcatggatccctctcttcctcggcgtccttgcttactgcacaggatccgtggcctcctatgacctgactcacgccaccctcagtgtccatatccccaggaccagacacgccagcactcacctgctcagagataagttaggggataatatgtttgcgtggtaatcagcagaagcaggccagtcccatgtnagtggtcatctanactaanattataacgcgtcctgtaggactcccgagtgcattcactcggctcgaattcgtacgtacggaacacagcccatcncgtaccatcgaaggccggaacccgagtacctaagagagtacggcggattaccggtaacgtttaaacgtcgttacggttaccgaacgggttacggttacccgggaaacgaccggtaacctaacccgggttaaccttaggggtttacccggtaccctttttccccgggttaaccggggggggaaaccccggggttaaacgggggtaaccccccgaaaaacggggttttcccgggtacccggggttttaaacccccccggttaccgggtttaaacccgggaaccgggtttaaacccccggtcccccggggtaaaaaccccgggg

SEQ ID NO: 61980 - DNA, 569 bp, Homo sapiens
  misc_feature: GYAE6OF02GPLRV.34.10.A10.1.454.CMB.1.raw
  modified_base (256)..(256): a, c, t, g, unknown or other
  misc_feature (256)..(256): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaattgggggataatatgtttgctggtatcagcaganccaggccagtacccctgtgatggttcagtctatcaagattagtaaagccggacccttcgtacggtactcccgtgacgcgtacttccacttcggacgtccattctccgtcgggtaacacgacgtcccaccgttctacggtaacccagttccaaggcccgggaacccacggtcctagtaggactagggacgacttagaacctttagttaccgttcgtactaggtacggtagggacagaccctaccgtagttggccgtcgtccgtcgggacggacggacacgtcgtcgaccgtcgtacgtcgaccgccgagtcccg

SEQ ID NO: 61981 - DNA, 682 bp, Homo sapiens
  misc_feature: GYAE6OF02IOOMM.34.10.A10.1.454.CMB.1.raw
  modified_base (253)..(253): a, c, t, g, unknown or other
  misc_feature (253)..(253): n is a, c, g, or t
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaagttggggataaatattgttgctggtatcagnagaagccgagccacgtcccctgtgatcggtacatctatacaagtattaagtaacgcggtcccgtcgtagggtactccgtaggacgcgtattccaccgtggcctaccactcctacgtacgggaacacgtacgcctacgtctacgaccctagtaccgtacggacccgggaacccgaggtaacccttaagtaacggtagtacgggaacggtccttaacggtaacccgtttattaacgtcggtaccggtaaaccggtacgggtaacgggaccaccgacccgtaaccggtaaccgttcggttacggtccgttcggttaccgggggaaccgggtaccgggaacccgtaaggtcccggttaaccggtaaccccgggttaccggtttaacggggaccccgtaaacccgggtacccgggtaaccggttaccccccggg

SEQ ID NO: 61982 - DNA, 899 bp, Homo sapiens
  misc_feature: GYAE6OF02FW7TS.34.10.A10.1.454.CMB.1.raw
tcagtacacgtgatcacgaccggtgctcgatttagcgtcgatctcagggctgggcctcaggaagcagcatcggaggtgcctccgccatggcatggatccctctcttcctcggcgtccttgcttactgcacaggatccgtggcctcctatgagctgactcgagccaccctcgagtcgtccgtgtccccaggacacgacgacgccagcagtccacctgcctcgtaggactaagtaaacggttgggggaaacttaaatacgtggtacttggacgtaggtaactcgaaggaccgtaagtaaccggacccgtaacgggaccccgtaccgttcccccgttaggttacggtacgttacggggttactaccggttacctaacgttaaccgaaagttaacgtttaaacgtaaaccgggtccccggacccctttaccggacgggttaccttcccgtaggacgtcgttaccgttaccgtacgtcggtaccttaccgtacgttacccgtcggtaaaccggtaccaacgtaccgtaccccgttacgtacccgttaccgacccgtaacgtaccgggtaaccgggtacccccgggaaccccggttacgggtaacctttaaacggttacggttaaacgggtcgggtaaacccggtacccgtttaacggtaaaccgttttaaccgttttaaccggtaccggttaccgtaaacgggttaccgggttaaccgggaaccgtaaccgacccgtaaaaccggttacccgtttaggacccggttaccgtttaaccgggttaccgggggaacccgggttaaaccggggtaaacccggtaaccggttacccggttaaccggttaccccgggttaacccggttaacccgggttaccggacccccggttacggtaaacccccgggg

SEQ ID NO: 61983 - DNA, 726 bp, Homo sapiens
  misc_feature: GYAE6OF02FJWLK.34.10.A10.1.454.CMB.1.raw
tcagtacacgtgatcacgaccggtgctcgatttagcgtcgatctcaggggctgggcctcaggaagcagcatcggaggtgcctccgccatggcatggatccctctcttcctcggcgtccttgcttactgcacaggatccgtggcctcctatgacctgactcagccaccctcagtgtccatactccccaggacagacagccagcactcacctgctcaggagagtaacgttaggggataactagtggtttgcgtaggtactcagcagaacgccaggtcacgttcccctagtcgattggtactatatactacgaacgtacttactaaacggccggtcccttcgtacgggtacttacccgtagacgtaccgtactttaccgacgtcgtcctaccgacttccgtaccgtacgggtaaccctaccgaccggaccctaaccgtcctaccggtacccctaagtacccgtaccgggacccgggaaccccagggtaccttaacggtaacggtactacggtaacgggtcccttaagaacctttaacctttaaccgttacggtaccgtaacggaaccgggtccggtaaccacgggtacctacccggtacttacggggttccgttaccgtccggttaccgggtaaccgggaaccggtaacccggaacggttacccctacggtaccccgggttaccggttaaccggtacccgtacccggacccgttaaccggtacccccgg

SEQ ID NO: 61984 - DNA, 531 bp, Homo sapiens
  misc_feature: GYAE6OF01DSUXY.45.74.G08.1.454.CMB.1.raw
  modified_base (350)..(350): a, c, t, g, unknown or other
  misc_feature (350)..(350): n is a, c, g, or t
  modified_base (434)..(434): a, c, t, g, unknown or other
  misc_feature (434)..(434): n is a, c, g, or t
tcagacgcgatcgacacgaccggtgctcgatttagtagctctatcagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctggggcggtcgctgagactctcctgtataggttctggattcaccttcaagagtcatggactgcactggtccgccaggccccaggcaaggggctggactggctggcagttacgcatatgatggaagtaaancatactacgcgactccgtgaacggccattcacatctccagagacaattcaagaacacgtgtatctacaatcgacagcctgacgncgtgaggacacggctgtcgtacttcgtgtcgccgagaggtacggttggtagggtcgggtattagtttacgtacgttacggtaccccgtgttaccggg

SEQ ID NO: 61985 - DNA, 582 bp, Homo sapiens
  misc_feature: GYAE6OF01BYIYI.45.74.G08.1.454.CMB.1.raw
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (409)..(409): a, c, t, g, unknown or other
  misc_feature (409)..(409): n is a, c, g, or t
tcagacgcgatcgacacgaccggtgctcgatttagtagctctatcagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggaggtcgggggggaggcgtggtccagccgtggggcggtcgctgagactctcctgtataggttctggattcacttcaagngtcatggactgcacgtgggtccnccaggccccagggcgaaggggctggactggctggcagttacgcatagtgagtaggaaagtaatcaatacgtacggcgactccgtaggaacggcctattcacatctacaganactaataccaagaacacggtatactactaaccaagtcgacacgcctgcgagcgtagacggaccacggctgtacttacttcgtgtacgccgtaaggtaggtaggttttcgggtacggggttagggtatttaggttttacggaccgtttccggttaacccgtaggtttaaccggg

SEQ ID NO: 61986 - DNA, 757 bp, Homo sapiens
  misc_feature: GYAE6OF01C4CA1.45.74.G08.1.454.CMB.1.raw
tcagacgcgatcgacacgaccggtgctcgatttagtagctctatcgagggggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagtcgtgggtgggaggtcggggggagcgtggtccagccgtggggcgtgctgagctctctgtataggttctgtattcaccttacgaagtgtcagtggactgctacgtcgggtccgccgacggaccccgagggaccgaaggggcctagggacgttgggctgggaccttaaggttaccgtactaagtagttaggaagttaagggtaaaactaaactactaacgtaaacccggtaaccggaccgggttaccgtccgggtaacgggaaaccgggtccgtaaacttacccgaacctacgtaccctaccgaacggaacgtaaacctaaacgttaaccgaaaacgtaaacgtaaccggttataacgtaacctaacgtaaagtcggaaccacggtcctaggaccggtacggacgtacggaacggaccgtacggttcggttcgttacgtttaccgttaccggtcgttaccggccggtaaaggttagggttaacgggttttgggtaacggggtttacgggttattttacggtttaacggtacccggtttacccgggttaacccgtagggttaaaccggg

SEQ ID NO: 61987 - DNA, 990 bp, Homo sapiens
  misc_feature: GYAE6OF01DSH65.45.74.G08.1.454.CMB.1.raw
  modified_base (172)..(172): a, c, t, g, unknown or other
  misc_feature (172)..(172): n is a, c, g, or t
  modified_base (189)..(189): a, c, t, g, unknown or other
  misc_feature (189)..(189): n is a, c, g, or t
tcagacgcgatcgacacgaccggtgctcgatttagtagctctatcgagggggggagacgagcccagcactggaagtcgccggtgtttccattcggtgatcatcactgaacacagaggactcaccatggagtttgggctgagcttgggttttcctcgttgcttacttttaagnggtgtcagtgtcaggtncagcgtgggtgggagggtcggggggaggcggtcggtccagccgtggggccggtcgcgtgacgtacttcctcctaggttagttagggtttctaggtactttacctaccctttacgaaaggtagttcctaagttcgggacttggacccacggttccggggtacccccgcccgaaccgggccccccgaaggggtaccggaagggggtccgttcgggaccttcggggtccgttgggaccttaagggtttacccgtacgtaagtttaagtaggtaagttaaacgggggtaaaatttaaaactccgtaaacgttaacccgtaaccgggtcccggtaacccgttcccggggttaaagggaaacccgggggttccctaaacgttaccccaaccccttaacgttcccctaaccccgtaaaggtaacgtaaacccttaaaccgtttaacccggaaaacggtaaaacccgttcgggtttaacccttaacgttaaccccgtaaacccgtaaaacgttcgggaaacccgtacgtacccgtacgggaaccgaacgggttaccgtaacgggggaccgggtaacccggttacgggttacccgtttacgggtttcggtttaaacccccgtttggtacggttcccgggaaaacccggttaaaggggttaagggggttttaaacggggtttttccgggggtaaacgggggggttttacccgggtttaagttttttttaaaccgggttttaccggggttaaccccccgttttttaaaaccccgggggtcccccgtttaaaggggttttaaaccccgggggg

SEQ ID NO: 61988 - DNA, 622 bp, Homo sapiens
  misc_feature: GYAE6OF01BA8RT.45.74.G08.1.454.CMB.1.raw
  modified_base (279)..(279): a, c, t, g, unknown or other
  misc_feature (279)..(279): n is a, c, g, or t
  modified_base (357)..(357): a, c, t, g, unknown or other
  misc_feature (357)..(357): n is a, c, g, or t
  modified_base (610)..(610): a, c, t, g, unknown or other
  misc_feature (610)..(610): n is a, c, g, or t
tcagacgcgatcgacacgaccggtgctcgatttagtagctctatcaggggggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggaggtcggggggaggcgtggtccagccgtggggcggtcgctgagactcctctgtagtaggttctggtacttcaccttcaagngtcagtcggactgcacggtcgggtcccgccgacggccccgaggcgaacggggctcggacgtggcgtggctagttcgtntatatggaataggaagtaaactcgtaatccgtacggcggtacctcggtaggaacgggcctagtaccacctctcaccagactactaactaccaaagtaccgtacgtagtaactccaacgaagtcgacgcgcgtaggcgtacgcggtagacggaccgcggtctgtcttacgttctacgcgcggtaggtagttaggtttcgggtaaggggtcggtttagttacggttttccgtaaccggttccggtttaacccggnggttaacccggg

SEQ ID NO: 61989 - DNA, 603 bp, Homo sapiens
  misc_feature: GYAE6OF02HFXNQ.45.74.G08.1.454.CMB.1.raw
  modified_base (251)..(251): a, c, t, g, unknown or other
  misc_feature (251)..(251): n is a, c, g, or t
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
tcagacgcgatcgacacgaccggtgctcgatttagtagctctatcagggggctctgcttcagctgtgagcgcagaaggcaggactcgggacaatcttcatcatgacctgctcccctctcctcctcacccttctcattcactgcacagggtcctgggcccagtctgtgttgacgcagccgccctcactgtctgcggccccaggacagaaggtgaccatctcctgctctggaagcagttccaacattgggaanaattatgtatcctggtaccgccagcctccccaggaaccacgccccccaaaatccctactatttangaacaataataacgcgaccctnagtgactttccngaccgattctctggcctaccaagtctggcacgtcacgcccacccgtgggacactccacccgggtactacccgaggaccgtgggggaaccgacgggcccgtaatttacttaccgtggaccggaaaccagtaggggatacggaccacccgtggcttcgtccctttggtcctttaccgggacccttggggaaccctaagggtccctacccggttccgtacgggtccaccggtaccccaacggtcccctaacccccg

SEQ ID NO: 61990 - DNA, 835 bp, Homo sapiens
  misc_feature: GYAE6OF02HMQPY.45.74.G08.1.454.CMB.1.raw
  modified_base (212)..(212): a, c, t, g, unknown or other
  misc_feature (212)..(212): n is a, c, g, or t
  modified_base (327)..(327): a, c, t, g, unknown or other
  misc_feature (327)..(327): n is a, c, g, or t
tcagacgcgatcgacacgaccggtgctcgatttagtagctctatcagggggctctgcttcagctgtgagcgcagaaggcaggactcgggacaatcttcatcatgacctgctcccctctcctcctcacccttctcattcactgcacagggtcctgggcccagtctgtgttgacgcagccgccctcactgtctgccggcccaggacagaaggtnaccatcctcctgctcgtggaagcagttccaaactagttagggaataattatgtactccgtggtaccgcagcctacccaaggaaccaccggacccccaaacttcctactaatttanacgaactaaataaactaacgccgaaccctcgaagttcgactttccgtacggaaccgttattacctcgtacggtccttaaccgtaaacggttccgtacgggaccctaaccgggtaccaaccggtaccccctaacccgttcggggacctaacgtacccgtaaacccgggtacctacccggaacggtaaccggttacggggggaccgtacgggtacccgtaagtttaccgttaaccgtagggaacccgggtaaactaagggttacggggtaacttaaccggtacccctaacccgggttaggtacccctttccgggttcccgttttttaccgggttaacccggttttaccccggggggttaaaaccccggttccggggggtaaaaacccccttaaaccgggggtttacccccggtaaacccccggttttacccggttaaaccggggttaccccggtaaaccccgggtaaccccccggtaaaacccgggtacccccccttaaaaccccccggg

SEQ ID NO: 61991 - DNA, 569 bp, Homo sapiens
  misc_feature: GYAE6OF02FV57U.45.74.G08.1.454.CMB.1.raw
  modified_base (423)..(423): a, c, t, g, unknown or other
  misc_feature (423)..(423): n is a, c, g, or t
tcagacgcgatcgacacgaccggtgctcgatttagtagctctatcaggggggggagacgagcccagcactggaagtcgccggtgtttccattcggtgatcatcactgaacacagaggactcgccatggagtttgggctgagctgggttttccttgttgctattttaaaaggtgtccagtctgaggagcagctggtggagtctgggggaggcttggtccaggccgggggggtccctcagactctcgtgtgcagcctctggattcaccgtcagtggcagcttcctgagctgggtccgccaggctccgagggacgggcctggaggtgggtctcgagttaatttttagacaggcacgagcgtactacgcagattccgtaaggcctatcaccatctccagacgacaattaccgaggaactacgggttntttctagaaatggaaccacccgtgacgacccgaggaccacggctctatattactgtgcgaagagactacgaacccgagacccggaagaacttcaacaactactacggtatacggacgtcgacggggacctaacgggaccctaccgg

SEQ ID NO: 61992 - DNA, 617 bp, Homo sapiens
  misc_feature: GYAE6OF02FXMFJ.45.74.G08.1.454.CMB.1.raw
  modified_base (272)..(272): a, c, t, g, unknown or other
  misc_feature (272)..(272): n is a, c, g, or t
tcagacgcgatcgacacgaccggtgctcgatttagtagctctatcagggggggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgggggaggcgtggtcagccgtgggcgtcgctgagactctctgtataggttctaggattcaccttcaagngtcatggactgcacgtcgggtccgccgacggccccgaggcgaacggggctgggactggctggctaggttacgtctatacgtgtagtaggtaataaatcgactacgtacgcggtactcggtggaacgggccagtccacacgtctcgagacgtaactacgttaccaaagtaactacggtagttacttacgaacgtaacgtaggactacgtccgtaggacgaggtccgagggtacgaccgacgggtctggtacgtacgttccgtagtccgacgtaacggtagttacggtttcggacgggttcgtaacggtactttagtttaccggtacgttcccggttaccgttacgg

SEQ ID NO: 61993 - DNA, 586 bp, Homo sapiens
  misc_feature: GYAE6OF02IBC7B.45.74.G08.1.454.CMB.1.raw
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
tcagacgcgatcgacacgaccggtgctcgatttagtagctctatcagggggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggcggtcgctgagactctcctgtataggttctggattcaccttcaagngtcatggactgcacgtgggtccnccacggccccaggcgaaggggctggactggctggcagttacgcatatgatggaaataatcaatactacgcggtactccgaggaacgggtccattccgaccatcctccaagacgaactaattaccaacgaacgacggttagtactctaccaaatcggacacgcctagcgaagcgtaggacggacgacggtcgtcgtcgttacttctagtcgaccgtaggtagtggtttaggttacgggttacggtaagttagttttacggtaccgttacggttaccccgtagttaaccggg

SEQ ID NO: 61994 - DNA, 616 bp, Homo sapiens
  misc_feature: GYAE6OF02H91R1.45.74.G08.1.454.CMB.1.raw
  modified_base (604)..(604): a, c, t, g, unknown or other
  misc_feature (604)..(604): n is a, c, g, or t
tcagacgcgatcgacacgaccggtgctcgatttagtagctctatcagggggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggcggtcgctgagactctcctgtataggtctggattcaccttcaagagtcatggactgcactgggtccgccaggccccaggcgaaggggctgggactggctggcaggttacgtcagtatgataggaataatcaatactacgcggactaccggtgaacgggccatttccaacctatcctaccagacgaacaacttaccgaacgtaacgacggtgtaactcctaccaaagtcggacacgcctgacgacgcgtaggacggacgaccggtcgtcggtactacgtttctaggtcgtaccgtaaggtacggttaggtttacgggttacggggtacgggttaacgtttaggttttaccggaccggtttaccgggtttaaccccggngtttaaccgggg

SEQ ID NO: 61995 - DNA, 790 bp, Homo sapiens
  misc_feature: GYAE6OF02IBZ4N.45.74.G08.1.454.CMB.1.raw
  modified_base (231)..(231): a, c, t, g, unknown or other
  misc_feature (231)..(231): n is a, c, g, or t
  modified_base (380)..(380): a, c, t, g, unknown or other
  misc_feature (380)..(380): n is a, c, g, or t
tcagacgcgatcgacacgaccggtgctcgatttagtagctctatcagggggctctgcttcagctgtgagcgcagaaggcaggactcgggacaatcttcatcatgacctgcctccctctcctcctcacccttctcattcactgcacagggtcctgggcccagtctggtgttgacgcacgcccgccctcactgtctcggccggaccccaggacaaggaaggtcgacatctccncgctcgtaggaagctagttaccaagtagttaggggaaataagttatgttactccggtacggtacccgcgacgtccaccgaagaaccaccgacccctaaactcctactatttacgtagaacaaaattaactacgaccgtacctagtagtntaacgttcctacggaccttacttcctcggtacggtaccttaccgtaaacggttccgtacgggtccgtaccgttaccgacccgtacccggtacccgggttccggacctaaccggtcccgtacccggtaaccgtaccggacggtacccggggttaacgggggtaacgacgggtacccgttaagtttaccgttaccggtacgggtaacccggtaacgtaacgggtacgggtaacgtaacccggtacccgtaccccggttaggtaaccccgtttcgttacccgtttgggtttaccccgtaccgggttaacccggtaacgggtaaacccggttaaccggtacccggttaccgttaccggttaacggtaccccggaaccgtaccccgggtaaacccgacccccgttaaacccccgg

SEQ ID NO: 61996 - DNA, 812 bp, Homo sapiens
  misc_feature: GYAE6OF02FVBXQ.45.74.G08.1.454.CMB.1.raw
tcagacgcgatcgacacgaccggtgctcgatttagtagctctatcagggggggagacgagcccagcactggaagtcgccggtgtttccattcggtgatcatcactgaacacagaggactcaccatggagtttgggctgagctgggttttcctgttgcttctttaagaggtgtccagtgtcgaggtgcagcgtggtggaggtcgggggagcgtggtaccagccgtgggcggtcgactgagactctcctagtagtacggttctggacttccaccgttcgaagacgtcgaacgttggactgcgtaccgtggggtcccgccacgggcccccagggtcgaacggggtctacggacgtcgggcgtgggtctaacgtttacgtccagttagtacggagttaagggaacttaaacgttcaacgtttacgtaccggcgggaccttccgggtaggaacgggtacccgtactttaccgaccgtacgtacctaccgtagaacgtaacctaacgttacccaaaggtaaccgtacccgggttagttaaccgttaccgtaccgtaaaacgtcggtaaccgtaccggtcccgttacggaccggtacgtaccggtacggtaaccggaccggtaaccggtcccgttaaggtttacccgttaacccgtttacgtttcgggtaccccgtaaccggttaaacggttacggggtttaacgggttttaccggggttaaacgggggttaccggttttaacggttttaacgttttttaccgggtaaaccccggttttaaccggggtttttacccccaaacgggttttaacccggggg

SEQ ID NO: 61997 - DNA, 936 bp, Homo sapiens
  misc_feature: GYAE6OF02FV8J0.45.74.G08.1.454.CMB.1.raw
  modified_base (167)..(167): a, c, t, g, unknown or other
  misc_feature (167)..(167): n is a, c, g, or t
tcagacgcgatcgacacgaccggtgctcgatttagtagctctatcagggggggagacgagcccagcactggaagtcgccggtgtttccattcggtgatcatcactgaacacagaggactcaccatggagtttgggctgagctgggttttcctgttgctcttttaagnggtgtccagttgtcaggtgcagctggtggagtcggggggagcgtggtccaggcctggggcgtcgctgacgactctccgtggtatagggttctggtacttcaccttcaaggacgtcagttcggacttcgcgtaacgtcggggttcccgccgtacgggacccccgagggaccgtaaacggggggtccttcgggggaacttcggggtccgtaggggtcccgaagggttttaacccgtacgtaagtacgttacggtagttaaggggaaaacgtttaaaagttccgtaaacgttacccggttaaccggtaccgggtaacccgtttcccggggtaaggggaaacggggtacccgtaagttttacccgaccgttaacgttcccgttaccgaaacgtacggtaaaccgttaaccttaaccgaaacggtaaaccgtaccgggttacgttaacttaccggttaacccgtaaagttccgggaaactacggtacccgttacggaccggtaacggtaccgggttacggaaacgggggtaccgtaaccgggggtaaccttcgggtttaacggttaaccgttttaccggtttcgggttaaccggtacccggggttaaaggggttaacgggttttaaaccgggggtttttaccggggtttaaacgggggggttttccccgggttttaaaaaggttttaacccgggttttttttacgggtaaacccccggttttttaccccgggggtttaacccccgtttaaaccgggtttttaaccccggggggg

SEQ ID NO: 61998 - DNA, 547 bp, Homo sapiens
  misc_feature: GYAE6OF01A1JLS.15.1.A01.1.454.CMB.1.raw
tcagtctacgtagccacgaccggtgctcgatttagacgtctcatcagggtcttcgtggctcacgtccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacggtataatagttactggtttggccactgggccagggaaccctggtcatcgtctcgtcagcctccaccaggcccatcggtcttcccctgcaccctcctccaacgacgcacctcctgggggccacgacggccggcccgtggggcctcggcccgtgggtacctaacgggtaccttaaccgttcccggccgttaccggtaacgg
